United States Patent 9,567,581 (SELECTIVE REACTIVATION OF GENES ON THE INACTIVE X CHROMOSOME) - sequence listing, part 13

SEQ ID NO: 1084 - DNA, 423380 bp, mus musculus
ctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaatttgggaatgtcaaagaaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccaggtgttctcacttgtaagtgggagctaaacatcgggtacatatggacataaagatggcaacaatagacactggggactacatgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtgtcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttttaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattgacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccgcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccttagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcagatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgtt

SEQ ID NO: 1085 - DNA, 423380 bp, mus musculus; identical to SEQ ID NO: 1084

SEQ ID NO: 1086 - DNA, 2351 bp, mus musculus
gaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggtgtgagggttcgggaaggctggggggctacaggtgggagctgtggagcagagaccagctccatcccactgggattgggccgggggattgaatggcacccctgtcagcaaccctacttggggttttcaggctgctcagaccctgatcccatcctacaggcagctcctgaagggaggggactctggaaggcagtgtctggggtgcaggggtaggaccccaggggaggcaagagcttagagcaggctatcaaaccagctccaagatgggcagaggcaagggcttccctttgggttggctttttaccgggaagggtctcgtagaggggaggggtttccttcccccagctccagctcctcacccctaccctaaccctcctttcccaaggcagcataaagagggcagttcagaagcagccacaccttcctgcttaccggacccacccactgtgcacccctctaagactccatagcctcgggagagctctgaggacaagaggtcctgtccctcagcccgcacgcacacatgctcacacactttgggtgtatccaggggctcctttacatactcaaagtcacctaaaatcatattgtaccgacagccagttgtgctgtcgcgtgcaaatgctgacacaaatcacataccgtctcgcgtagaatcagtcacgtacccagccaagtctggggatcagctcagtcagccaaacccagaagcataaggtacaggggtcccctgccccaagacaaccacaccccgcatacacacctttgccctgcgtttgttgtactttcaccaaagctaacttagagggtggggctcctaaaggcgagtctgggcttctggttggggttgggggatgactgggcaggaaagggcaggacttgaggggaggctctgtattttgaaaatccaaagattcctttagaagactgggagtgacccaggcaacatgttcacctcaagtctttctctttttggcagtgccctttgtcccctgagaggtggacacagagaatctttcagggatttgtgatctgaataatctctataaccatagcaactggccaactagctgggccttccttagccccaggtcagaactgtaacctttgcttcaggttactcctgcttcctgggctggaaagcaattcaacatggggttgcctccagcttggccaaacctgctttaacttgctgaactgagtttgtcccaccctgggcagtttctcttgagttcttacccccagggcaagcactccatccccagaggtgtgtgctgttaaatggggaggagctggagagagtggatatgaatcctgcccgaaaagaggctggacctcttgggtgtcccactgactctccaggtaacaagattaaagggaaacgaaggctctggagactgtctcccattgccaggcttgcagctggggctgctcgcctcatccactctggcactctgggcctgccccgtgacctccgttgctgagcagcggcccaggcctctgcctctcccccgggctcctcagatacactaggagggagactgggatctgccctctgccagggtccctgatggtcgagtgtcccttcccccaggccttcaccatggccgagtcccccggctgctgctccgtctgggcccgctgcctccactgcctgtatagctgccactggaggaaatgccccagagagaggatgcaaaccagcaaggtggagtagggatggaggggggaggctggaagtcagaaggcagaggctcactggaggggataaggaggccaattgtgctcatagacagcttgggggaaggggctctctctcccaggaagaaaatctccctcaaatatggaaagagctgccccccgagcagagcagcccaacacggggcaggcagctccctttagctgccacccgttggggactctgagtttgaagtaggtattggttgtgagtttctctcctgcccctttgcagtgcgactgtatctggtttggcctgctcttcctcaccttcctcctttccctgag

SEQ ID NO: 1087 - DNA, 2351 bp, mus musculus; identical to SEQ ID NO: 1086

SEQ ID NO: 1088 - DNA, 10371 bp, mus musculus
cgcgcgatggggggaaggaggggcgcctgccgccctcctcctgggtcagggggcggggcatgcggctggaggccgccctcagccggccaatggccactccactggcccgcaggctagggcgcgccttcccgcggctcacctcggcacctgggcctcggttggccccagccaatcaaacgcctttatttgcatgaccagccccgcccattcgccccagccaaggactgctcactgagaatacaaagaaggccccccggaggggagggagtcgactccagttggcctatcccaagggcatagtatcaccttttcagcgcgtttatgggtctttcacggtcatcttgatgaggggaggggagtgggggtcacagaggtttggcccaagatctcttaagaggtcggatctcttctacctgaggtccttctaaccaagagctgctctcctcttccagggcacacagttcccagtcttctcctgtgggccctccgccccctcccctttttccagtcgccctaatctttggatgctgcttccagtaggctgctgcccactactggccttctcctgcactgcagcccacatcagcaggctctgagcacagccttaattgatgctttcaagccgcccaaaccaacccctacccagcaggaaaaggagagaggaagaggttactgctctaggtagaagggacctggtcaagtggctttgttacctaggatggcaaaaagccaacacataatataagtctaactcccccacatcatctcttcccaccttcccttctcctaccttcaggtctgtactgggccacaatggtgactgactggccggcccgtttcagagcagctgcagcctgctcatgagttgcattcctcagattcactccattcacctgtccaaagagagaagctgtgagccaccccaaaagcaagaaagagggtcctctgcattagcagttaggagagggagatgggtaccccacccctaagcctgtttagatgcctttcccaatattccaaccttgcccctaaaacaaggcctaaaggatacgacatctctagtgtaacaattatcttcataaaggtcaaatgccaatcagggttaagatccaataggcattcatttcctcttcaaagataagtctagtcccggtccctgtcactaaggatgtctataaaaacaagagaagttttctccagtccttagccctcccttcatctcaagaagcattcctcggaggaagtaaggtctctcgctctccattttagactggcacagttcccatcctcccacctctcctttgtctcctcaccgataagatccggtctcccctgcgcagctccccactcaggtcagctgggcctcctgccaggatgaaggagacaaaaatgccttctccatcctctcctcctacgatgttgaagcccaggcctgtggagcctttgtgcaggatgatcttgcgaggctctctggtgggaaaggagtggaggagtcaggactaggtagatatggactgttgtcctttgagggccagcctggaacaaggtccatacttgctgtagggagtaaggacgtggttccctatgtatgataccctgagcctccctttgtctcctgaaacctgcttggctgctgttctgtcaggtgccaagtttcagttcctcttccctcccttcttcccgagggcttgcagtcaacttcccagtggacagtcccctactctctcgggtgaacaaatccctaccctgaactccagagaccaaatctcaggcccactcactggtcctcttccttcccagattctcctatcctaccaacccgtgtgatggaccctggaccacaagaagaggaagcagttaggggcagtggagtcaccctggggttgactgcactcatcatccacaggatgtgcacacttacttcacagacactcttctgcagtctcaaaatctcacccatcaactatgacccctcctacctgctgccccaacaacatatttaatcagcagctaacactatgtagccccagggggttgcagcgcctgggttcttagggggatcccaggtccccaaaaggagtttagaatccaaactgaagagagcagacaagcacatgagaaatgcgaataaaactaaccacatctaaggaagccctctgtaaaaggtcacagtgtcatccgcccaactcccagggcacgttcccggcccaccgccttcacttgttacaagcatctttcctcggaggagcccaaagccccacgcaagactcttcctttcttgctcccagtctcaggggcgagactccctccctgagtcccggatgctcttgctcctagccctccactcctacctggcatcccctccgggccgcagggagcggagcggccaggcccacctctgcgaagccctcctccaggccgaagcggaggcggagcccaagcccatggccaagccggagcccgagaacttgcgggccctctccatagctcctctctctctcccctggctgcctacccttccggctccactgctgcctgcccgccagcctctcgggccccaccctgcaaacctgtcccccggaaccccagccggcccgaccagttccaggccccgcgcagccgctgccgccgccgctgccgccagcggggcggggccgttgccggcgaggccaccgggccggtcagagtcccgccagccccaccggctgaactgctttcttctctaatttgaaatggttgcagcagagcgggctgcaactatctcagggcaggaaactccgctgccctcgcctcctcagccccctaaacgctccaccccatcctttctttatctgcacttttggaccggggccactcactcggcactccccctgatggtagagcttgtccctgcagccacttctgtccctctctaggtccccaaggcctgagagagggcctcggaccccaaagccgggagtgatgagggccttatcctcttctttgccatactacaaggagcctgtggccggccagaaacggattcctcccctccccaatttctgggtagattgaatgggatgttgggggcggggtcttacctggtgaagtcctcctcagccagcatgtgcctgggaataggagagtagcgggtggggggaacctgaggaggagcagggtagctgaccttgctctccacagccccgagataacccaggctggaattatggcttatgtggttgtcagccaaggcagtaaaagctggaatcaagaaagggagagaaaagttcagagactggtccagggaggtaccccaaactcctcaaggactttcccccacaccccacttcagatgcaaaagagaccaagggatgctgattcctcaggccgcacctccccactccatccacccgccacccagggttcctcctccgcagtccctttctaaatccttggctcactcctgtgagtcttagaaagagctgaagtcaaggcagtctacaaagaaaggcatgactagaggtgtgactaataataatccctcacatctctatagcctaatacagttttccaagggttttctcatccatgatctcatttgatccttgcagcagtcctatgaggaaggcagcacatacatcattagctcccttttgccaaagaggaaacaaaaaacaggtgaaagggacttgtctaagggcacccagctctaagggacagagctgggggccaggcacggtggctcaagcctgtaatcccagcactttgggaggccgaggtgggtggatcacgaggtcaggagatcgagaccatccttgccaacatggagaaaccccgtctctactaaaaatacaaaaaattagccaggcatggtggcaggcacctgtaatcccagctactcgggaggctgaggcaggagaattgcttgaacccaggaggtggagttcgcagtgagctgacatcgtgccactgcactccagcctggcgacagagcaagactccgtctcaaacaaacaaacaaaaaaacaaagacagaactgggatctggactcagttctgtgcactatcctctgcggcttctctctctcctctttttaaaattcactctccatagaaattgtcaaaaattgccaatgctgactctatggcaagtcttcacgatggggtactgagcaaagttttcaattagcaataatggcgcctcagataaaccttattggctgctacagtgccaccactgagcaaagctgcttgccctctcttaacaaagggtatgaacttcttcccctccagaaaccaggggacagagctttagaccagggacaggggctgatgagtacgtactgctggcgtagtcagggggagcgtacatgtcgttgaggtggaggctgcctggcttggccaccttcaaatacaccatatcagatgtgttcttcagtgaggccacagcttcctcgtgcctcacatcctgcagattggtgttgttcacctagaagaggagaggcctcaggctgggacttggaagaaggagaggcttctccagggaactcgagggatgccttttcagtgaaattcaacagcatgctaacaaaggcccaagtatagtgctgtgaggagcagaggcaggaggtaggggatagggcaagaccctggccacagaaagaattagggcctttgtatctgggcaaacacaacacagatgataactcttgaaattcccccatgatgcctcatccctgagtgaggtttaggcggagtaaggggtactggagctcctcctccctaccctaccatttgggcatccccatgaagtctgtctcaccgccagcagccggtccccaatctgtaggcgtccatccttctgagcagcacccccctcaatgatcttggtgatgtagatgctgttgtctcctgggatgtgctggttgccaatacccccagcaatgctgaaacccaggcctgagcgggagccagcaggaggtgggagagggccacaaggagaggttaaagtgttgtcgatcccaaatccaaaccccctcccccagccaacccactggccccacaggagctccccccgggggatccaaacgctaagctgccatcctgagatgagtaagggtgaggcctgaggtcaaaaaagtaggctgtgagttggaacagggggagtcaggcaaggagtaaggccattcccttccaattccctatggggcaagatgggatctggggcctaaggctctggctggagcacaggaacctggagggccgcacctttgggccctttgagcaggttgacctccatgatggtctcgggtggaggctgtcgcctccgcaccaccaatcgcaccacagggcctgcctccttcagcgcctccaccgcccggctgtgtaccacctccgacacgtccacctcattcacccgcagcacacagtcattcaccctgtgggggaagcccgagaggcatgacactgtgcccctacccctccaccccctctcctgcttcctcccacttctctgtcctcccctcctctgccctcccaccccgccctcagatctaatggaagggtcatcctgccaggcaggctttcctcccctcatctcgatcctgtccctgccacccacaaccctgcttccaggccatctcaccccagcctcccatccatggcagctgctccaccagggataatcttggtaataaagatgccagggtcatcagggacatggggattgtcgatgccacctgcgatactgaagcccaggccagagttgccctgcagaagtgggtggaaaggcacagtctgttcactctgagggcacaaaggagagttctgggtacctcatctccccttatatcccagagctagttctccaggcctcagaaggggccatggcaggctgggcacatttgtcagacacccagcctctgctgatcattttgggaaacccatcccctccccaattccccaggcctcagtgagcaaggtcaattaatatttgttagtgggttgattgattgatgcagtgaagcagcctctgagggccgctgtttcaccatcctctaaatgcaggtccccccatgggtcttgaaaccatgattcaggggtctcccttatcctggctccaaccctctccttccctttccgcttttccccactggcagactcaccctctcaagtacgatttcctcatatttgaacatgccatcactgccattcacctagggggagacacaggcagttcccttagtgccccctgcccttccagccatctgccccttagtcaacctgcctcctcccctactcccacagagtagaagagcccaagtgcaccccaggtcacctcttggccacagatgaggacaggctgacctggaagaggccgctcctcactcaccccaccaatccctgctttgcttccaaccatatcagcccaaaccaagctgctcatttagcccagatcaattgtctgagactgagccagccagtggtgcactcaccgagaggctgtgcttcagtgtctcagggttcactaggaggggtgcaggcctggcctaagggggatggcagagatggagcatggcaggcaaaccatgccacacccagtgtccataggggatacccagtggcctagacagataacccttccccttctgaaccacagttctccctgactgggggatcatagactcccactgtgtccgaactggaaggacagcagacatcatcttgtcctatcccctttatgtgacagtaggtgacacggaggcccagagaagacatgggatgtgcctaagggcacactgggaattagtgacagagcaataggatatccaggtgttcttttgattacagtaagctcttaaggccactgatgttttggtcactcatccccgtaccccagcagagctcatgggaaaaaggacagttgccccactttggagcacctcgtgagtcttcactctatacctctttcttggactccaggaacccaattcctcaaataggcagaaggagtcaaagtcctaatccattttctaccaaaggatttttgattctgagccctttgtttttcccagcagaaagggcgagggtgggatctggtcaggagtcagagacaaagccacgggtgggactggagcagggtagacaagattccccatgagggagaagttggtgacccacaggctgattggcagcagagtccatggttttcaatatgtagtagccatgcaagaagaggcaagggaaggggtcagaaacacaggggtgatttggccaacccacagagatggcctcccagacaggacatgtgtgtatctatttgtcaagtgaaaatgtgattctggacatacaagcagcacctgcctgctggctcccactttcacctccaagaatggagaagccctcttgcctgtctccccaggtaccctggcacccctcccccacctttctctggctatgttgtcccttccctgacctctagcctcctcctcagaagtggggagctggaaaccagggtgggggctcctccacatgtcctgctgtgcttcccccgtcccacctccaccccacacagctttggcttcaagaagcagagaggaggagagggagagaggactagctcatcatgcctccaccatttctgggctggctctgcagctgtgggagttggtgggaggactccagctacagccttaccctggtctgtgaccccaggaagaagaactgaaggctccttagagacccgaaaccaacacagctgccttaagtaccatgcaacagacacataagcaaagggacacccatgtggctcttgtgtgcatttggtgtaccatgtgtgcccacatgtgacaagccatgcctcaagcccagccccagtggtacccagaggcttcccgttcccagtggtccacgctctagcccccacccctactcaaggaccttgttctcagggccaggagccatccagggatcagccctggcaaagaaaccttggccaactggcccagcctgggattgccacctgtctcccagccgggcaggacaagcataagagggtgtttgcgagagaaaggcctccaggacagagagggggcaaaggagagagagggactcgctggaaagggcaagaggccaaggcaagggatgtgggaaagcagtaagtgtggacagacagaaggccagaactgagggctcttctccccaggaagtccccacctttgcctctgagtgagagcacatcctatccccagaggacagaggcagccagaacggtcaccagcttggggaagtcatcacctgccctcgacagcaaagcctcctcttcctctctccccaccctaggagctgcagagccggataaccagacaggccctccgccttgcgtgccagggacctggctctgccagcccagcctccattttgctgcttctcccacagatgctccttccattttctaagctggcagtttaggctgggagtggaagccggagttgtgcccagcacccaggggctcccaagctgtgccaagtcagggctggggggctaagccctctcacatctggaggtacccaagggggacatgccccactggggccagtctctgcaccagggcagctgccccttgccggctccaggcaccatgcctgctctagagcgaggaggcttgcttcagttccttcaaatctccccccgccccccgccaccccaccccggcacacacactacagagctgcttggacaaaagagtccgtccttctcagcagcctctcagccttgcttgggacatgtctctcgcctccttcctctcccctcccttgcctgtcaagcgcctctcaccagagacaacacatacaaacacacactcacacacacacaccaggcacacgcgtgcacactcttgcagccacatgctcacacacatatacatgtagccacacacacaaacacagccatccctgcagcctcctctacagagacctctccacattcagagtgacatctccacacatccatgtgcacattcacacacaaagggactgggacggagagggactcatggcatcaagggatgaagctcagcgagccgggcacatgggctcctccacacggattcacggcagctccattgccttcctccacacaccccaacatacatacacacacatatgtcccccctacgcagagcaccatgccccctcccctcccctccggtggagacacacaccacacacagcccccgcagaacctcccgccccctgccagacacagagacattgccaaacccccacactgagacaaacccaattcccccacacaggaaaatgtgcccctccgccatgcccttaccccctgacacacggctcctcccagtcttctaatggagacccccaaacagacacacacagggaaccacacatttcccaccgcctctctttgcccagctgcaatgctagggctcggggtccacaggcttggagccccagcgacccctactgcatcccaggcctctaggcccccactctccagccctcctgggttgccccaccgctcccccctccgctggtccatacctgctcataccagtcccggttggtacaggtgcactctggccaccagctggggccgctgccgttgagtttgggggtgctcttgcccgggactggcttaggaggcaccggccccacatcccggccggtggggatgagcttggccttggtgcgaggggtgggggtggcccccgcctgcgagggcaaggtctgcgagctgtagcccccataacccgcgctggcgccgttgcccccacctggcccgtaagggtcggggacttgccagtcgccgtagcccggaggctcgaggcgccgcagggcggccaggcgggtcacctcatagcactcagggcacttacagcagtgctggtgcttgtgcatggcactgccccccgcggctcggaccccccagcccacgccggattccacgccgccgccaccgccgccaccaccgccgccgccgccgccgggctccctggcacactcacactgctcggaccaagaaggggggggcacccgtgggggcgcccgggctgagcggggcctggggccgggcgggcgtcccggggcctcggcccccacgctgccccgcacccacggctccccctccagcactggcggctccgtgtcgcccgtcgtggcttctgggccgaggcccagcggcaaagaagaagcgggagctcaagcagagaatgggtgctgtgaggaccgcttctgctctggtccccaggatggatctgagtggagtcaagagcatctctccctggctcccttctcagttgattccagccaatcagcgcgcagaggcaggcagcggcagcggcagcggcggcggcaggaatgctaa

SEQ ID NO: 1089 - DNA, 21421 bp, mus musculus
aacctatcaaatttacagaaattgtcttaaaaaataatactccacattagtgaggatcttgaaatagacattcttatactgtcagtggaaatggaagctaattggccaaatacatcaaaaaccttaagtatgttcataccctttgatccaattaattccaccttaaaaaaatcttttcggaacataatcagagattcacaaaaaccgtatacaagggtatcaatcagaatgttttgtgtaatatcaaaacattggaaataatctaaatgttcaccaacaggggaatggttatacgaattatggcacacacatgatgaaatattatttaactattaaaaaccatttttttcaaaaaatatatggtgatcgaggaaaatgttcatgacataagttaatgggaagaacataaaactgcttaaagccaataatctccttcttaaaacagatagatacaaacatattatatgatatatgtaatataaatatataaaagtttagagggaaatacacagaaatatacacatacaacagtggttatctctggatatagttttacagatgatttgaatttactttactttgtatttttctgtattttccaattttccacaaatctaaatgtaatatacttttaaatgcaggagaaaaatataatttgaagagaatgggaaagtagactgaacaggacaggctcaaggacaaagccaggacacacatgcactagaaacttctctccacactgctcctggcttcattaatcattttcctctgggactattcattcaaccagttccagacaagtccagttaaacatattatcaccattatcacccagccatcttatccaaaagtagaccaaagaagttttgtgaatgccttgcagaaatctagatatagtgcatctaccgtatttccctaatctacagcccagtaaccctgtccatcaagaaaatttgatcaggctgacaagacttttttgtccttggtgaaccaataccagttcctagtgctcaccacttctttttctgaatatttacaaaacaactcttaatctaccctggaatttaacccaaaatttgcaaaattctctcctttttgaaaatccaaaggacgtctacttaggcccctaatgtacatatttatacaaaatatgttaattttctactcaaattttttatcacttaatttcatcaagtagaaaaatcataaaatctctagggcctttgcttttttagcacagtggtgccatctcagcccactgcaacctccgcctcccagattcaagagattctcctgcctcaacctcctgagtagctgagattacaggggtgtaccaccacgcctggctaatttttgtatttttagtagagatggggtttcaccattttggccaggccggtctcgaattcctgggctcaagtgattcacccttctgggcctcccaaagtgctggaattacaggcatgagccaccacacccggcctgcttttttaaagatacctaaattcagcaaaaaataaacaaaagtccatttcaagaggggaagacaagaccctcataagcaagactgttactagctcaagactgtgagtcttggccgggggtagtggctcaaagcctgtaatcccagcactgctggaggcggaggcgagggaatcacttgagctcaggagttcaagaccagcctgagcaacatggcaaaacccagtctctacaaaaaatacaaaaattagcagtgtggtagcatgcacctgtagtcccagctacctggcaggctgaggtgggaggatcactggagctcaggaaattgaggctacagtgagccatgatcacaccattgcactccagcctgggtgacaaagtgagacaaaagaaaagagaaaggaaagagaaaggaaaggaaaggaaagagaaaggaaaggaaagagaaaggaaaggaaaggaaaggaaaggaaaggaaaggaaaaagaaaaaaggaaggaaggaaataaaagtctatgctgggtgcagtacctgtaaccttagcactttgggaagctgaggtggaaggactccttgagcccaggagttcaagaccagcctgggcaacatagtaagatcttgtctctatacaaaaaaataaaattaaaattaaaattaaaaaaggggctgagtgcagtggctcactcctgtaatcccagcactttgggaggccaaggtgggtggatcacttgagtccaagagttcaagaccagcctgggcaacatagcaagaccccatccctaatttaaacaataaaagagtccaggtacaaataggaaattgtaaattgaattcacaactcactaccacttatctgacacagaatttgaggtacacactagtgaccattttgcacagtctcctcattttatagatcaaaaaattgagtccctaagaggaaggttgactagtctaagatcattcagctactctaagtcagaacccagggccttggctcctctgccaagattttatatatatatagatttcatacatatatacattctcacataaaaggagcaaaaccgatatattttacaaaaaacaattaccctattgtgcaatataagactaaagctttaaacaaaggaacagtgtcaatatcagagtcaagatttcaacaagcaacatattaaaccaaaaagaaatcctaaaaagctacagttaagtaagaaataactcattctcaggcttggcacagtggctcaagcctgtaatcccagcactttgggaggccgaggcaggtggatcacctgaggacaggagttcgagaccagcctggccaacatgatgaaccctcatctctactagatataaaaaatttgctgggcatggtggcacatgcctgtaatcccaactacttggaaggctgagtcaggacaatcacttgaacccaggaggcagaggttgcagtgagctgagattgcgccactgcactccagactgggcaacaagagtgaaactccgtctcaaaaaaataaaataaaataaaataaaaagaaataactcattctcattactgttattctaatcattctaccctatcaggaaaaactgatgttttacagacaccaaagctcctaggattttgcctcaaaccatctaacaaagacgagaaagcacctgaccagctaaattcagagtgctttactaaatctagcaccatgtccttgggttacatagaataaagaaaagcccaaaacaaacacacacatatgaagttcagctccagggggcaaaattgaaaagaaaacgtaatctttttttcttttctaagtatatagaacagggctgggcctaaaagggtgtagctacttttaaaaaaagccagacagttcctcaaaaatgctaaacactaagttacctatgacctagcaattctactcctaagcatatatcacctaagagaactgaaaacatgttcatacaaaaacttgtatattaatgttcatagcagcagtgttcacaatagtcaaaaggtggaaacaacccaaatgtccatcaactcaagaatggatagacaaaatgtggcataaccataggatgaaatattgttcagccataaaaagtaatcaagtggccgggtatggtggctcgcgcctgtaatcctagcactttgggaggctgggaggccgaggtgggtggatcacctgaggtcaggagtttgagaccagcctggctaacatggcgaaaccccattgctaccaaaaatacaaaaaatagctgggcatggtggtgcacatctgtagtcccagctactcaggaggctgaggcaggagaatcgcttgaacctgggaggcagaagttgcagtgagccgagatcatgccactgcactccagcctgggtaacagagtgaggctctgtctcaaaaaaaaaaaaaaaaaaaaaaaagaaagaaagaaaaaggaattaagtactgatacatgctataacacacatgaatcttgaaaacattatgctaagtgaaaaaagccaaacacaaaaggccacatactgcatgatttcatttatatgaactggccagaagaggcaactttatgaaaacagaaagtagactggtagttgcctagggctgggggggcggtgggggggggatgaggagtgattgctaatggggtcagggcttctttttggggtgatatgttctaaaattgattgtgatgatagttgcacaactctaaaaattctaaaaattgttgtaccctttcaatgagtgcattgtagcatgtgaattatatctcaatcagcaattttttgttaaaaaggtaggcccttggctgggcatggtggctcatgcctataattccagcactttgggaggccgaggcgggcggatcacctgaggtcaggagttcaagaccagcctggccaacatggtgaaacctcgtctctacaaaaatacaaaaattagccgggcatgatggtgggtgactgtaatcccagctacttgggaggagaatcccttgaacctgggaggcggaggttgcagtgagctgagattgtgccattgcactccagcctgggtgacagagtgagactctgtctcaaaaaaaaaaaaaagggggggccctatcatttttatcagatcagcattcctaagctaaaattatctacgcccaaagccttaaaccccccgagcacacaaagcagtgagaagtagttatcttcctggttctttctagttgcctaataacatagttggcttgctctggtctcaagtcaatttggaaacagagagagaatcaagagaatcaaatcaggggacgaagcaaaacaaaagtgaatagcaaacaataagcacatgaaaaatgtgcaacattagccatgggggaaaattcaaatcaaaaccgcaattagataccacttcacacctaccaggatggctagaatcaaaaggacttacaataacaagtgttggggatgatgtggagaaattggaacccttacatactactggtgggaatgtaaaatgttgcagcctaaatgtggaaagcagcctggccattccaccaaaggtcagagttgtcaaatgatccagcagttccactcacaggtatgtatactcaagagaaatataaacatgtccatgcaaaaacttgcacacagatgttcacagagcattattcataatagcaaaaaagtgaaaacaacccaaatgtccatcaaccgataaacaatacgtggtatatccatataatgatatatattcagctataaaaaggaatgaagtattgatacatgtacaacacagatgaaccttgacaatattatgctaagtgagagaagccagtcacatattatatgaatctagttatatgcaatgtccagattgggcaaatccatagagacaaaaagtataatagattagtggttgcttagacatgagggggatggggagatgaagggtgacagctaaagcgtacaggggtgattaaaattctaaaatcaattgtggtgatggctgcacaactctgtgaacattctaaaaaccgcttaagtatactcttaaatgaatgaatcgtaaggtcataaaaaatgaatgacaaatacaactccatttcacttgaagaattaaaaaatgaatgcttgcttattccattaatatccttaagcctgcacacgtttactattaagtcaggcaaaccaactcccatcttttggctcctcctggggttcccccaacagtatcattccctggtagtcttcctaaatccactttccttctgcctgagaagggatctccctcaggcttcccagcaggccatctaccctcaagttacttcttcctgtttatggtcatcaagactaaaaagctgagatttgggagtttttttttttttttttttttttttgagacagagtctcagctctgacaccaggctggagtgtagtggcacgatctcagctcactgcaacctccacctcccgggttcaagcgattctcctgcctcagcctcctgagtagctgggactacaggcgcatgccaccacacccagctaatttttgtatttttagtagagatggaatttcaccatgttggccaggatggtctcgatctcttgacctcgtgatccacccaccttggcctccaaaagtgttgggattacaggtgtgagccaccgcgcccggcctgggagttcatttatactgcatttgttgacagcttctggcacttgaagagtctcagagtgatatcttctgctgtagccagatgtctctgggtagggagatagttgtggcctggtgacaaaagccctggactcaaagaagttctccagaaatctgtactcaaacttttattctgtcccttacagacttgtgtgaccctgagcaagtcactcaaccactctgaccctcactttcctcatttgtaaaatggggataatgccacctaatccacagggatattctgaagattaatgcttataaaagttatctgaaacagagataataattcaacaaactatttgccaggctccatactagacgctggggacacaaagataaatgtaatactagctgccttcaaattgttcacagtgtacaaatgctgctgataggaaatcattttctttcttccttaccttgccttcttttaggatgacaacgggaatttcagaactttgactccctgccttggtatactctcacctttgtgctttcaatgctgataggatagcagttacatttacatccttcattctcaaaaagggggagatagaatggttacttaaatgttatggggaaaatatcccttttatgctttcaagttattaacaccactgatttctaactcttccaggccttacccaaaggtgtttccatggtaaaagtatgcttattcagcaccttaaaataacttacagaaatactctcattctctctcactccttgtacccccagcctgcctggatttacattcccgaaaagactggtcataaaggatcatttcccagttaagctaccttaatgaccaatttctggctcacctcctgtttttgagatcagtttctactctaaaaacaaaagggctttcaagaaaaatactagatcagtttataaacagaggctgatataaagtcactacggggaaaatgtaggagatctcaaaatgttctaacacataacccatccttcccttggtgggacaattccacaagtcacagaaaaatatttttcattttagaatagattttaagagagcctttgccaagagccagttgtttaaattttcaattgaattttaagcagtattatacatgtccaagaacatcatgctatttttagctaataggtaggattgctgtgtccataaccgtttagagcaatcaggagtgaaaccactaaatagtatctcttactgtggtatcttatcatttagcatttctatttctattttaatattttccaaagcctcatcataaaaacacctgtaaagcacccatgctgggcacaatacaaagttcaaatagaaagacacagttcctatacttcattatgggttaaacccacattaagcaaaccaggtatttgaaagaatcttggctgggcattatggctcacgcctgtaatcccagtgctttgggaggtcgaggtgggaggatcacttgggccaggagttcgaggccagcctgggcaatatagtgagaccctgtttctacaaataaattaacaaataaaaaaagaatctcacagttagagcattctcaagttgccaccagcctctaagtatccagaggaggaacattaggaagcaattgtcctaaacccatcatctttctaatgcttgcacaccttttatgtattaaaagaagaggggtaaggaaaatgttctaggccgggagcggtgatcccagcactttgagaggccaaggtgggtggactgcttgagctcaggagttcaagaccagcctaggcaacatggcaaacccctatctctactaaaaatacaaaaattaggctgggcatggtggctcacacctgtaatcccagcactttgggaggccaaggcaggaagaatgcttgagcccaggagttcaagaccagcctgggcaacatggtgaaaccccatctctacaaaaaatacaaaaattagccaggtgtattggtgcacacctatagtcccagctactcaggaggctgaggtgggaggatggcttgagcttgaggggcagaggttgcagtgagccgagatcgtgctactgcactccagcctgggcaacagagcctgacactgtctcacacacacacacaaaaagttttaggccgggcacagtggctcactcctgtaatcccagcactttgggaggccgaggcgggcggatcacaaggtcaggagattgagaccatcctggctaacatggtgaaaccccgtctctactaaaaatacaaaaaattagccgggcgtggtggcgagcacctgtagtcccagctactggggaggctgaggcaggagaatcgcttgaacttgggaggcagagcttgcagtgagccgagatcgtgccactgcactccagcctgggcgacagagcaagactccgtctcaaaaaaaaaaaaaaagtcctaaaacgtactgtggtgatggaggcacaactatacctaaagtcactgaaatatatatctaaatgaggaaactgtatggtaaatgacttacctctcaataacaccattttaaaaaggagacaaattgtcttactctgattgttctattagtcaaacctattttttaaatctctcatgctaaaggctgcactggtttggcaaaggtgcctcagaggccaccatggagatcactctaaccttcccctccacatccatctttctttcccttacactcttcctagtctgtcctctgttaattccccagtatccttcctgttgctcctccacttttaactaggtgttaggtccctcaggtgttcacaagcatggtctgtcccaactggtagacctcaggattaagctgatttgctgaccctctgatgctgaccttcagcaactttcccttcttagacaagttatatcttggctctcttgtcattgtttcagtatgcacaatgaagaattggaccacttgatcctttccagctctcacattcacgtgaagaaaaaaaaattcaagtaatgaacacttacttggccaatcacatgcaaggtctcttgccaaccaacatacatgtatttggattattcattttgtaaatacccaccgtgatgtaatcctctgaagaaccacacttgtttataaattgatcaacatggagtccttatttttaaaaactagcactttaccaaagaaaatttagagcccaacacagaatgcttgacagtccctctggaccagtctccagggatctgttttcaaaaggggaaaaaaaaaaaagcttttgcatgttggggacttgctggatttaccaaaccaaaggaggaagtaagattgattggggtggcagagccttaacaacagtggttcacctaaatcctaagagaagaaaggccttatttggcaagtagtagaaagaactagcataaaacagcacctcaacctacattataaactctcagaaatatgctcagagagcaataaacactgcaggaatccccttaccctggacaacctgcagctttttatgcaagccagttgcattcccctaacaagtcatagaaatatgtagtcactagtatccagcatacccccaccacacacaattcacagtattgtttccatgtgcccaacatcagagagcaaaaccgaaagaaacatcaatttctcctacaacatacacacacaaatacgcaagaaaaaccatttcctttgcagaacctgtgttgtctaagttgtgggcatgaaatgcacaaatattagttgctaataaaaatcagacggttagctctgtactggaaagcgaacagcacacacataaatcataaaaaaacaatatccctaaggtgcgttcctgatcagtaagctgaaaaccaaacaaggagagaaatgactcaaagtgtccatttgcatccctctttctcattacctcagaccaacaagctctctctcctgtgagttacctccctgcacttctgtcctcgatcagaagagcctcgtggaaaaggtcgcaggctctctcttctttcccttcaggatcttgaggcactgaaggagcatggggggaggggaacggaaaggacaaaggtaggcgctttccatccctttcggcttggcgacggggctcccagcctctccccctctcatcgcggaaatagagcacctgccagggagaggtcggtcccttccaccttagtaatcggcccacagggcctaggtgtcccaggagcccaggcgctgcagccctaggggacaaaggggaggaggaggcgaaagaagtcgggaatggtacgaatcccttgcaaacaaaagggagggggcagaataccaagccggtcgcggctgttctcagaggtggacaggttgggtggagaaatgggtgtcgggggaggggaagatttagaaaattcctctagggcaagggattagggagctgcttgggggcgcagcagccagcaggaagggggctgaggcaggacagaggccctggggtgagaagggggcacagctcgctgtgggggagaggtgatggctaagaggtgaaggccagactgggcccagtgtagggtgagggggcgctgagccccgcgcggcgctccgaggggccctgaggagggtctcagaaggagcctgggggcacgcaacgaaggcattcgagggagagggcagaattggggcacgcagtgttggaaaagaggctgagaacagagccgtagagaggttaggggggactgcgagggggcctgacccccgtccgccccacctcacctggcgccgggtcggagtccagatctagtgctgagaaagcgccagctccggccagtccctccgtcccgcgcgggagaccacggacacaaagcggggcgcgcgggaggaggggaggagagaggagggggaaggagggaggaggaggagacgcctgaggcgcgcgatggggggaaggaggggcgcctgccgccctcctcctgggtcagggggcggggcatgcggctggaggccgccctcagccggccaatggccactccactggcccgcaggctagggcgcgccttcccgcggctcacctcggcacctgggcctcggttggccccagccaatcaaacgcctttatttgcatgaccagccccgcccattcgccccagccaaggactgctcactgagaatacaaagaaggccccccggaggggagggagtcgactccagttggcctatcccaagggcatagtatcaccttttcagcgcgtttatgggtctttcacggtcatcttgatgaggggaggggagtgggggtcacagaggtttggcccaagatctcttaagaggtcggatctcttctacctgaggtccttctaaccaagagctgctctcctcttccagggcacacagttcccagtcttctcctgtgggccctccgccccctcccctttttccagtcgccctaatctttggatgctgcttccagtaggctgctgcccactactggccttctcctgcactgcagcccacatcagcaggctctgagcacagccttaattgatgctttcaagccgcccaaaccaacccctacccagcaggaaaaggagagaggaagaggttactgctctaggtagaagggacctggtcaagtggctttgttacctaggatggcaaaaagccaacacataatataagtctaactcccccacatcatctcttcccaccttcccttctcctaccttcaggtctgtactgggccacaatggtgactgactggccggcccgtttcagagcagctgcagcctgctcatgagttgcattcctcagattcactccattcacctgtccaaagagagaagctgtgagccaccccaaaagcaagaaagagggtcctctgcattagcagttaggagagggagatgggtaccccacccctaagcctgtttagatgcctttcccaatattccaaccttgcccctaaaacaaggcctaaaggatacgacatctctagtgtaacaattatcttcataaaggtcaaatgccaatcagggttaagatccaataggcattcatttcctcttcaaagataagtctagtcccggtccctgtcactaaggatgtctataaaaacaagagaagttttctccagtccttagccctcccttcatctcaagaagcattcctcggaggaagtaaggtctctcgctctccattttagactggcacagttcccatcctcccacctctcctttgtctcctcaccgataagatccggtctcccctgcgcagctccccactcaggtcagctgggcctcctgccaggatgaaggagacaaaaatgccttctccatcctctcctcctacgatgttgaagcccaggcctgtggagcctttgtgcaggatgatcttgcgaggctctctggtgggaaaggagtggaggagtcaggactaggtagatatggactgttgtcctttgagggccagcctggaacaaggtccatacttgctgtagggagtaaggacgtggttccctatgtatgataccctgagcctccctttgtctcctgaaacctgcttggctgctgttctgtcaggtgccaagtttcagttcctcttccctcccttcttcccgagggcttgcagtcaacttcccagtggacagtcccctactctctcgggtgaacaaatccctaccctgaactccagagaccaaatctcaggcccactcactggtcctcttccttcccagattctcctatcctaccaacccgtgtgatggaccctggaccacaagaagaggaagcagttaggggcagtggagtcaccctggggttgactgcactcatcatccacaggatgtgcacacttacttcacagacactcttctgcagtctcaaaatctcacccatcaactatgacccctcctacctgctgccccaacaacatatttaatcagcagctaacactatgtagccccagggggttgcagcgcctgggttcttagggggatcccaggtccccaaaaggagtttagaatccaaactgaagagagcagacaagcacatgagaaatgcgaataaaactaaccacatctaaggaagccctctgtaaaaggtcacagtgtcatccgcccaactcccagggcacgttcccggcccaccgccttcacttgttacaagcatctttcctcggaggagcccaaagccccacgcaagactcttcctttcttgctcccagtctcaggggcgagactccctccctgagtcccggatgctcttgctcctagccctccactcctacctggcatcccctccgggccgcagggagcggagcggccaggcccacctctgcgaagccctcctccaggccgaagcggaggcggagcccaagcccatggccaagccggagcccgagaacttgcgggccctctccatagctcctctctctctcccctggctgcctacccttccggctccactgctgcctgcccgccagcctctcgggccccaccctgcaaacctgtcccccggaaccccagccggcccgaccagttccaggccccgcgcagccgctgccgccgccgctgccgccagcggggcggggccgttgccggcgaggccaccgggccggtcagagtcccgccagccccaccggctgaactgctttcttctctaatttgaaatggttgcagcagagcgggctgcaactatctcagggcaggaaactccgctgccctcgcctcctcagccccctaaacgctccaccccatcctttctttatctgcacttttggaccggggccactcactcggcactccccctgatggtagagcttgtccctgcagccacttctgtccctctctaggtccccaaggcctgagagagggcctcggaccccaaagccgggagtgatgagggccttatcctcttctttgccatactacaaggagcctgtggccggccagaaacggattcctcccctccccaatttctgggtagattgaatgggatgttgggggcggggtcttacctggtgaagtcctcctcagccagcatgtgcctgggaataggagagtagcgggtggggggaacctgaggaggagcagggtagctgaccttgctctccacagccccgagataacccaggctggaattatggcttatgtggttgtcagccaaggcagtaaaagctggaatcaagaaagggagagaaaagttcagagactggtccagggaggtaccccaaactcctcaaggactttcccccacaccccacttcagatgcaaaagagaccaagggatgctgattcctcaggccgcacctccccactccatccacccgccacccagggttcctcctccgcagtccctttctaaatccttggctcactcctgtgagtcttagaaagagctgaagtcaaggcagtctacaaagaaaggcatgactagaggtgtgactaataataatccctcacatctctatagcctaatacagttttccaagggttttctcatccatgatctcatttgatccttgcagcagtcctatgaggaaggcagcacatacatcattagctcccttttgccaaagaggaaacaaaaaacaggtgaaagggacttgtctaagggcacccagctctaagggacagagctgggggccaggcacggtggctcaagcctgtaatcccagcactttgggaggccgaggtgggtggatcacgaggtcaggagatcgagaccatccttgccaacatggagaaaccccgtctctactaaaaatacaaaaaattagccaggcatggtggcaggcacctgtaatcccagctactcgggaggctgaggcaggagaattgcttgaacccaggaggtggagttcgcagtgagctgacatcgtgccactgcactccagcctggcgacagagcaagactccgtctcaaacaaacaaacaaaaaaacaaagacagaactgggatctggactcagttctgtgcactatcctctgcggcttctctctctcctctttttaaaattcactctccatagaaattgtcaaaaattgccaatgctgactctatggcaagtcttcacgatggggtactgagcaaagttttcaattagcaataatggcgcctcagataaaccttattggctgctacagtgccaccactgagcaaagctgcttgccctctcttaacaaagggtatgaacttcttcccctccagaaaccaggggacagagctttagaccagggacaggggctgatgagtacgtactgctggcgtagtcagggggagcgtacatgtcgttgaggtggaggctgcctggcttggccaccttcaaatacaccatatcagatgtgttcttcagtgaggccacagcttcctcgtgcctcacatcctgcagattggtgttgttcacctagaagaggagaggcctcaggctgggacttggaagaaggagaggcttctccagggaactcgagggatgccttttcagtgaaattcaacagcatgctaacaaaggcccaagtatagtgctgtgaggagcagaggcaggaggtaggggatagggcaagaccctggccacagaaagaattagggcctttgtatctgggcaaacacaacacagatgataactcttgaaattcccccatgatgcctcatccctgagtgaggtttaggcggagtaaggggtactggagctcctcctccctaccctaccatttgggcatccccatgaagtctgtctcaccgccagcagccggtccccaatctgtaggcgtccatccttctgagcagcacccccctcaatgatcttggtgatgtagatgctgttgtctcctgggatgtgctggttgccaatacccccagcaatgctgaaacccaggcctgagcgggagccagcaggaggtgggagagggccacaaggagaggttaaagtgttgtcgatcccaaatccaaaccccctcccccagccaacccactggccccacaggagctccccccgggggatccaaacgctaagctgccatcctgagatgagtaagggtgaggcctgaggtcaaaaaagtaggctgtgagttggaacagggggagtcaggcaaggagtaaggccattcccttccaattccctatggggcaagatgggatctggggcctaaggctctggctggagcacaggaacctggagggccgcacctttgggccctttgagcaggttgacctccatgatggtctcgggtggaggctgtcgcctccgcaccaccaatcgcaccacagggcctgcctccttcagcgcctccaccgcccggctgtgtaccacctccgacacgtccacctcattcacccgcagcacacagtcattcaccctgtgggggaagcccgagaggcatgacactgtgcccctacccctccaccccctctcctgcttcctcccacttctctgtcctcccctcctctgccctcccaccccgccctcagatctaatggaagggtcatcctgccaggcaggctttcctcccctcatctcgatcctgtccctgccacccacaaccctgcttccaggccatctcaccccagcctcccatccatggcagctgctccaccagggataatcttggtaataaagatgccagggtcatcagggacatggggattgtcgatgccacctgcgatactgaagcccaggccagagttgccctgcagaagtgggtggaaaggcacagtctgttcactctgagggcacaaaggagagttctgggtacctcatctccccttatatcccagagctagttctccaggcctcagaaggggccatggcaggctgggcacatttgtcagacacccagcctctgctgatcattttgggaaacccatcccctccccaattccccaggcctcagtgagcaaggtcaattaatatttgttagtgggttgattgattgatgcagtgaagcagcctctgagggccgctgtttcaccatcctctaaatgcaggtccccccatgggtcttgaaaccatgattcaggggtctcccttatcctggctccaaccctctccttccctttccgcttttccccactggcagactcaccctctcaagtacgatttcctcatatttgaacatgccatcactgccattcacctagggggagacacaggcagttcccttagtgccccctgcccttccagccatctgccccttagtcaacctgcctcctcccctactcccacagagtagaagagcccaagtgcaccccaggtcacctcttggccacagatgaggacaggctgacctggaagaggccgctcctcactcaccccaccaatccctgctttgcttccaaccatatcagcccaaaccaagctgctcatttagcccagatcaattgtctgagactgagccagccagtggtgcactcaccgagaggctgtgcttcagtgtctcagggttcactaggaggggtgcaggcctggcctaagggggatggcagagatggagcatggcaggcaaaccatgccacacccagtgtccataggggatacccagtggcctagacagataacccttccccttctgaaccacagttctccctgactgggggatcatagactcccactgtgtccgaactggaaggacagcagacatcatcttgtcctatcccctttatgtgacagtaggtgacacggaggcccagagaagacatgggatgtgcctaagggcacactgggaattagtgacagagcaataggatatccaggtgttcttttgattacagtaagctcttaaggccactgatgttttggtcactcatccccgtaccccagcagagctcatgggaaaaaggacagttgccccactttggagcacctcgtgagtcttcactctatacctctttcttggactccaggaacccaattcctcaaataggcagaaggagtcaaagtcctaatccattttctaccaaaggatttttgattctgagccctttgtttttcccagcagaaagggcgagggtgggatctggtcaggagtcagagacaaagccacgggtgggactggagcagggtagacaagattccccatgagggagaagttggtgacccacaggctgattggcagcagagtccatggttttcaatatgtagtagccatgcaagaagaggcaagggaaggggtcagaaacacaggggtgatttggccaacccacagagatggcctcccagacaggacatgtgtgtatctatttgtcaagtgaaaatgtgattctggacatacaagcagcacctgcctgctggctcccactttcacctccaagaatggagaagccctcttgcctgtctccccaggtaccctggcacccctcccccacctttctctggctatgttgtcccttccctgacctctagcctcctcctcagaagtggggagctggaaaccagggtgggggctcctccacatgtcctgctgtgcttcccccgtcccacctccaccccacacagctttggcttcaagaagcagagaggaggagagggagagaggactagctcatcatgcctccaccatttctgggctggctctgcagctgtgggagttggtgggaggactccagctacagccttaccctggtctgtgaccccaggaagaagaactgaaggctccttagagacccgaaaccaacacagctgccttaagtaccatgcaacagacacataagcaaagggacacccatgtggctcttgtgtgcatttggtgtaccatgtgtgcccacatgtgacaagccatgcctcaagcccagccccagtggtacccagaggcttcccgttcccagtggtccacgctctagcccccacccctactcaaggaccttgttctcagggccaggagccatccagggatcagccctggcaaagaaaccttggccaactggcccagcctgggattgccacctgtctcccagccgggcaggacaagcataagagggtgtttgcgagagaaaggcctccaggacagagagggggcaaaggagagagagggactcgctggaaagggcaagaggccaaggcaagggatgtgggaaagcagtaagtgtggacagacagaaggccagaactgagggctcttctccccaggaagtccccacctttgcctctgagtgagagcacatcctatccccagaggacagaggcagccagaacggtcaccagcttggggaagtcatcacctgccctcgacagcaaagcctcctcttcctctctccccaccctaggagctgcagagccggataaccagacaggccctccgccttgcgtgccagggacctggctctgccagcccagcctccattttgctgcttctcccacagatgctccttccattttctaagctggcagtttaggctgggagtggaagccggagttgtgcccagcacccaggggctcccaagctgtgccaagtcagggctggggggctaagccctctcacatctggaggtacccaagggggacatgccccactggggccagtctctgcaccagggcagctgccccttgccggctccaggcaccatgcctgctctagagcgaggaggcttgcttcagttccttcaaatctccccccgccccccgccaccccaccccggcacacacactacagagctgcttggacaaaagagtccgtccttctcagcagcctctcagccttgcttgggacatgtctctcgcctccttcctctcccctcccttgcctgtcaagcgcctctcaccagagacaacacatacaaacacacactcacacacacacaccaggcacacgcgtgcacactcttgcagccacatgctcacacacatatacatgtagccacacacacaaacacagccatccctgcagcctcctctacagagacctctccacattcagagtgacatctccacacatccatgtgcacattcacacacaaagggactgggacggagagggactcatggcatcaagggatgaagctcagcgagccgggcacatgggctcctccacacggattcacggcagctccattgccttcctccacacaccccaacatacatacacacacatatgtcccccctacgcagagcaccatgccccctcccctcccctccggtggagacacacaccacacacagcccccgcagaacctcccgccccctgccagacacagagacattgccaaacccccacactgagacaaacccaattcccccacacaggaaaatgtgcccctccgccatgcccttaccccctgacacacggctcctcccagtcttctaatggagacccccaaacagacacacacagggaaccacacatttcccaccgcctctctttgcccagctgcaatgctagggctcggggtccacaggcttggagccccagcgacccctactgcatcccaggcctctaggcccccactctccagccctcctgggttgccccaccgctcccccctccgctggtccatacctgctcataccagtcccggttggtacaggtgcactctggccaccagctggggccgctgccgttgagtttgggggtgctcttgcccgggactggcttaggaggcaccggccccacatcccggccggtggggatgagcttggccttggtgcgaggggtgggggtggcccccgcctgcgagggcaaggtctgcgagctgtagcccccataacccgcgctggcgccgttgcccccacctggcccgtaagggtcggggacttgccagtcgccgtagcccggaggctcgaggcgccgcagggcggccaggcgggtcacctcatagcactcagggcacttacagcagtgctggtgcttgtgcatggcactgccccccgcggctcggaccccccagcccacgccggattccacgccgccgccaccgccgccaccaccgccgccgccgccgccgggctccctggcacactcacactgctcggaccaagaaggggggggcacccgtgggggcgcccgggctgagcggggcctggggccgggcgggcgtcccggggcctcggcccccacgctgccccgcacccacggctccccctccagcactggcggctccgtgtcgcccgtcgtggcttctgggccgaggcccagcggcaaagaagaagcgggagctcaagcagagaatgggtgctgtgaggaccgcttctgctctggtccccaggatggatctgagtggagtcaagagcatctctccctggctcccttctcagttgattccagccaatcagcgcgcagaggcaggcagcggcagcggcagcggcggcggcaggaatgctaa

SEQ ID NO: 1090 - DNA, 99 bp, mus musculus
ggtttaggcggagtaaggggtactggagctcctcctccctaccctaccatttgggcatccccatgaagtctgtctcaccgccagcagccggtccccaat

SEQ ID NO: 1091 - DNA, 7372 bp, mus musculus
aactgcggctaaggagacgttcggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaaggtaattatgaccctcttaccttcttcccaacaccatctaccccctggaccccctagcctcccttacttctactctggggccccttttactacctcccacccccaccccctttgggaagcccagagatccaccttcaatctccagttagacaaacatttacttagtacatagtatatgccacactcggtgcttgatgctgaaggatcacagatgaataagacactgtccctgccctggagaaaattgaattctctgctcactgctcaatattcgcagcactttggcttgggctgccccaaacacttattcccacagagaagtctttatcctatgtacagcaggaactgtgtggattccccacatgaacctacccttccctcctcccccacctcccaccccaacaccttttctcccattcctgtgggattacttggattccctgcttgcctcccagtacctcagtgtagtggtactgttctagcactgctctacccaggaggagggagtgcagtggcaaagggtaaaaacaataatattcatggggaaaggtagctgatctcatgcactaagaagaaaaagggctgtgagctgccacttggctcagcttaccctgtgctgccaagaaactctcccttgtaaggggctatccaagttttggggggaagtcatcctttactgttaaggaatattagtcatgaagaaggaggtagggctctgactttagagcacaaagttgggagttctcttggccttctgtgaagaaactgtgagagaatatctcaaaggatactctgaaaaacttgtcctgagaaaatatggggctgtaatcacaaaattggggagcctcaagccctattgctggcttgtacctctctaggtggtgaggtcagcatataaccaagtacagaaggttggatgagcagaggaacttcccctaggtataggagactgagggatcagatctgtgctatccctaggggctgggcagaacagaagataggacagctgactgagacccttggcactatttctgggtagactgccacgccacagtctcagctcataaaaagctcccctccttggacccagcctacacagctgtttttcttttcccttaggttcattttccagggtagaggaaataacaagttgttagttatattgtgggagtatagtccgtccttataatctacacttctgtggggctttagagtttacaaagtagtttttaaagtttttattttattaatctttacagcaattctgagattccacattttacacattaggaaactaggtaccaaaaggttaggaaattcacctaataacagcagggtgaggacttgaactcaggtctaactataaatcatattctctaaaaagagcctggcttgctctaattggaatgagggcaaagtcaaatcaggctgagcctgggacttcaaggcccccccacccctctctgaggggaagtctcatgcctgaactggcctccctgatgatatgccaaggttactcccaccccaccagggggcggcactcacttagaacaagaaagtttagattaggtggcttagggagcaattagcagtcacccccaccaccctgccctccaacatgtaagagttatgggcttttgggaaactgacctctccaattaagagtctgtgtaccacttgctagttccaaggcctaaagaagaggagacaaacgggccttgtggctattaagtagtagggaaaggaatggatcttctcaagtagatccagaattagaggataaaaagaggagaaatcatagtgccaggtcatggtcattgtggtccttagttactatgaggtgaggccggatggacaagtgccactccttgaaggaacatcagcacagttgaaatgccattacctcagggtcccaggaacacaaggagttctttggctaaagaaccctggaacaagaagcatcattccccaggcaaaggtgctccttatcttaagagcaccagtcagagaaacaagtagtttctgaccgtcccatgtactcagcctcctagttgctctaagcacttctgggctcctcctgaatttctaaactaaagacctccaagtgggaggtcaaatgcccccaaggttgaagagtttatgcacaaattcctgagaaatgggggaaaggcactgggaaggaggtagggaaaagaaggcaggtttcgggaaggggggtggccaggggagggccaaaccccttgtgtaactagcctgccccgcggcaatcagtaaatataagctgcactgggggctgaagaagctgccaatctcagctccctgggccactggaaagcatcgtttccctagtagaatgtcaccagtgagggaggaagggaaaacatacagcttccaatacccaaggcactgaagagctggcagagcctcaaggggagcctcaccattgtcaacccaggggcaacccaccaatcaggtacaaatattgattatgtactgtgagcttgagtaggtatagaatatgtgctgtgagcttggtgctctgggagggctttgatgggggatgtgggactggaggacattacacttggcacttacactcgatgagacgaattacatgaaaccataagccacacaatataaattgggtgaaattgtgtggcgcagattttaaaaatactatactagaaatttggctgccaaagtcaagcagccgctttataaaagaggtggaactgaagcttggtcttgacggaactagtaaaacttagagaggggagatccctcctcggaaaagaggggaggggaagattgcacctcacgcatttgaggcacagcaggaagcctgaacctgaactgaatgtagttgaggatgtgtgttgtggattggaagaaataaggctgggattcagggaggggggaaaaaggaatctttaaattctatagagagctgggtggcccaaatgctctgtggggaatggagcacctgctgtgctgagattccagcccttcagcctattcagagaactggctctgggcagggcgggtccatcctgggctggtgctgtaccactgtcccgtaaactctacccaaacctgcactcaaggaaaggggtgcaatgctctttcccacctgaacctagttcttgctgggcaaggagcacgtctccccagtgcccaccagccccaggtaccgctccccccaccccccgcaaaacacacacgaagccctgggaagagcagagtaccaggagcttttccagggtgggcatcccccgtgctctctgcagtggattattacacgttatctcccacccgctgtacagagaagtctggagcagaggctgagcagcttgtctgggagcgggaaatgtgtgtggtctcccctcacaccccacccccacccctacttctaccagttttcccccctggattcaactttctttgagtctccaggaatacccctgctgtgttccagcacccttttatcttttatctttttctctttttttgtaaattatttaaagtttttcttaaactttaatgacctgggaaatgaagccccgaaatgaaccctgctgcggtggtggcaccaaatcctaaaccctagatcatcagggtccagcatcctcttagacttgaccgctggccactgacctcccctacagtacctcacgcccctttcctgccatctctgcccctccagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccaggtacagtaccccctaatcaccacagcacctcatagcctattaccactcctaggtgcccagctagtcccatgatctgggcgaaggggagatttaggacaagtggtagccagagctcctggggaactggagggaagatgtcatattacagtagcatagtttccggatgggacctccaggccccttagctgtgcccagccctgcaaggtagcacagaaaaggtatgtgtatggaagcgggttaggtgccaccatcttctttggtgggaatctggatgatagaatgttggcaagccccaggtaagcctcttaccttgttctctgtttcttcttcccacagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccag

SEQ ID NO: 1092 - DNA, 13912 bp, mus musculus
agaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaaagatataacctctcccagatgtggatgcaagtctcaatgctctttgtgttggtggtcagctgtgcattctgtcaggaaatttactttgctttcctcagtatccggaacgctcatcagctctgatgattggggagctgggctcaaatttgaactagtcaccttaaccttggtagaattaaataatttgtccatggtttcccatttcaaccagctagtgaagtgctacggtcgaattcccagtttaagtatttacagttgtgacaagcagttttttttttttttttttccctctctgggctttagctatatcctttaaagatctttatgtatctggattaagtcacttgcagcgaagtgcttttatttattcattatgttgcgctttatcaaatatattttagcgtccatcctccctccctcccaacgttttgaccattgcagttgcaggtaactgcctggcttatataggcttgtttgcaatgtcttaatcctttagtcaataccagagctgtttggaaaatgttagtgctaaaccaacgtgggtgggatttagccaatttagtctccttttgagtttgggatggtagaggagcagtgtaatcttgggtctttatttaaaatgtttgatgacccctttaactattttggctgttgtcaaatgacaaacatcttgtttatcagctgttttaaaaatagcactttgactttttggtttttcccttaggctcgtttctacttgtccttttaaagaattaaattctgaaatatacaaaaattgatataatttaaagaattaacacatctggtgtcctcactgaggttaagattgatagattgttaccagtactccacctcaacaaatccaacctgaaatatggcacaaaatattacgtttcccaatatgttattctgatattattaagtctttgtgaccttgcaaatcacacgtttaatattttgtttctgtatgttaactaaggtataaggaataatgttcagtgaatccttagatgctacctatgatttataatttaaaagtacaaagtatttttggtcataaaatgtaatctcatatggaagtaaatattcctttctagtttgggaaagaaagtattaatgggtgaattctaaaaatgccaattctgcacttgatgttaacttgaagatatacataacgtgcagaacactctagtgctttacatagtttcaagcatttccatttttaagttaaatataccatatttttacatttttttggtttacatttctaactttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacaggtaggagatgttggggtacctgctcgtgattgctgcctctgggtgctgagcttgaaaaatgatacttaaatatttgaacttgaaatttttccagtaccgggtttcaactgagccgccaacgcacatctgctctcttgcccacttgtgacatgcccagctgccagtttttctccttccttttgtggtggtggttatattatcagtatgactagggaccttttctagatttttctatctgggtctgctgctttctagactctgttcaggtaataaattattatcaatgtatatctgagcatccagtctccctttcatgagacctgtcagtttgagggactgaaatgctcagaaatgatggttatgtatgctgtggcaggagatgcatacctggagtttcattaagttgttatggtgtgttgcttttagttaatcagttgaattaatcaaaagggaagaatttgtgttcctgtccttttaataattgttattctggcatatttagacacttaaagatgtgcatcattaaatcttaaatggaaaatgagactcgtgcacatagctttccattttttatcttaatgatcatgatttccaatgtggtgggtttttttttttttttttttttttgagacggagtttcgctcttgttgcctaggctggagtgcagcggcgccatctcggctcactgcaactctgcctcctgggttcaagcgattcttctgcctcagcctcctgagtagctgggattacaggcatgtgccaccacgcccagctaatttttgtatttttagtagaaacggggtttctccatgttggtcaggctggtctcaaactcccgacctcaggtgatctgctcgcattggcttcccaaagtgctgggattacagacatcagccaccgcgcccggccaatgtggtagttttgtaacaagactctagttagaatttttttcttttttttgaggtggagttttgctcttgtcacccaggctggagtgcagtggcgcaatctcagctcactgcaacctccgcctcccgggttcaagcgattctcctgcctcagcctcctgagtagttgagattacaggcgcctgccatcatgcgtggctaaatttttgtatttttagtggagacggggtttcaccatattggccaggctggtctcgaacacctgacctcaggtgatcctcccgcctcagcctcccaaagtgctgggattacaggcgtgagccactgcgcccagccaataattttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttctgttgtgattaactttggataaattctgataagtgtttgcaagttaattgattttcaaggaatggtggataatgggtcttaatctgtaaaatctgtaatataaaatagtttgaaacaagatgccactatatggaatgatgtgaaaattaggctacaaaatttcttcctcaatatcctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggctgtactcatactcctgggctcaagcagtcctcctgcctcagcctccagagtagctgggactataggtgtgtgccaccacacccagcttctaaatttattggtttttgaatggatacagtgaatacctccagttagcactcttggaggtagcaaatgaaactaatttcttgtctatcttttctgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtgaaagagtagaatgttaaggtggtatctttggtaaccttggtaactgttttcaacagtgtttatctttttaagttaatagatatgtcaatttagaagttgttctctgtgacttgattatagaaattatctttgagacagctatctcatttttttcattctgaattatcttctataattataatgttgggtgttttcataattttggtaagattttagtctgtcattttttttttttttttggagacggagttttgcccttgtcacccaggctggagtgcagtggcgcgatctcggctcactgcaacctctgcctcctgggttcaaacgattcttctgcctcagcctccgaagtagctgggatcacaggtgcccaccaccatgcctggctaattttttgtatttttacaaaaacaggctttcaccatgttggccaggcttgtcttgaactcctggcctcaacagatccgcctgcttcagcctcccaaagtgctgggattacaggcgtgaaccactgtgcctggcagtctgttgtatttgaaggtgttattgcagatagcaccttgcagtgacagcacatgttctttgacatggtgactcactagagttgcctatacctggcaattccttttgcaaattatgtataaaattgtcctttctgtaacggctataaccctgagttgttttaaacaggtctgtttctgaatctataggttgttgaattgttgcttgtgctttgattgtggatgcacagaatggagagctgctggcatcctggccatcatgtgtgttcctgtcatgttatttgttacttgttactgctgagcctctcttatacagctgcactgtagaaaaccatatatttcgattcttctctgttctgctttctgttgtatatttcgattcttctctgttctgctttttgttaaggttgctgtgcaaatgtcacatttaaatatgtgagtgcttattgtgcatacaatgctttgttaggaaatggggagatgtgttgtgggggaagttgcgggttataatataagacaggacctgacccgtaaaggaaaaaatggtgtaagttccttggatgataattgttggagagtattaatcagaagatttcctcgagtgggtgcttatgacctaagcattctgtaggaaggtaaatagcaagtagacttccttggctgaagtggtgagtcaagtagtaacaagaagtgaatgtagtagaggagagtcaattggaagatttataaagaatagagaggctgaggagtttgaatttaatttgagaggcaattgagaattactgtaggtttttatcgacctgattttacttcatatgtatgtacgtgtctagatgttgtggctggtgggggtgggaggctctaggaggaaaggcaggaaactgatgcaatcttaggagaaatagttctacaggaaaatcttgctcatttctatctccttttattctcacgattttcccttgtatacagtgccctcctcctttgtctattaaaaccctactcatccttcaaggcccagcttaaacttctcttatgagctcatcatctagttctcttaaaattctttactactgagtgggcatttagtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagcattgtgttaacttgatatagtatactgtaatggatctagatgataacaaaatatagatatgctgtcaggacttaagtggcatccatccaagagttcatagaaactagagggtaataaaattacgcaacagctggctactatgtatggccattacagtcattgttggagaattattgcaagacttctgattattatgacttagaaaaggcataggaattggtaaaagtccaaacatgtataaccacaattatcaagtagtagaaggagcttgtatgcatggattggattatgcagtcatggtctgccaaaacaggggtaaccctttcagtttagaaaaaaacataaccatacaaagtagatagcaagattatataattcattacttctgagagtatagtgttaaaaagtgctcaggctaattagaggagaagtcaaataagattaatggtacctttgatgttttgaggattagtattagccttttgtgcttgaagtgatgggagacaaccttactctctagaacatcagtcattgcttgaaggacagtattgagtcagggagatgatggaactgacccagtatggctgaccgtaagattgttgtgtggcagcctgtactttgttggcagactttttggttcacctgatggatgatactatacaaccacaaaagctgtttatcagtagaattaagtgattttggaaaccataatatagttccagagcaaatcatatatatgatgatttttcggcacagttgacaaaatttcactttctaggacttaagtctctttcacccatggaacagtttggaataataagcatacttcctgttgtcattgtttctgcctgttgactggtagatgtgactgacaatggcaaaatagggcaaataaaaatttaagctcactgttgtgatgagtgtctcatccagatgaatggactgatgagtcagatgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccaggctggagtgcagtggcacgatctcggctaactgcagtcactgcctcctgggttcaaccgattctcctgcttaagcctcccaaatagctgggattacaggcacacgccaccatgcccagctaatttcatatttttagtagagatggggtttcgccatgttggccaggttgatctcgaactcctgacctcaggtgatcctcccacctcgccctcccaaagtgtggggattacaggcatgagccaccacgcccggcctgatatatatatttttaatgtgactgacatttggggaggagagaaagaagctctagtaaggtcccatagtattttatgtgaagctaatggggccaaatgcatttcaacattcagaatttttaggatattagaaagataataccatatataaaacacccagaaaagtctggagcagcaccttttagtaaaacacatttatatttctgcagcaaaagacagtattcatactaagtgagataattaaattctataaatagtttcatgtcacctcaagtcaggtttaaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattct

SEQ ID NO: 1093 - DNA, 13912 bp, mus musculus; identical to SEQ ID NO: 1092

SEQ ID NO: 1094 - DNA, 13944 bp, mus musculus
ccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaaagatataacctctcccagatgtggatgcaagtctcaatgctctttgtgttggtggtcagctgtgcattctgtcaggaaatttactttgctttcctcagtatccggaacgctcatcagctctgatgattggggagctgggctcaaatttgaactagtcaccttaaccttggtagaattaaataatttgtccatggtttcccatttcaaccagctagtgaagtgctacggtcgaattcccagtttaagtatttacagttgtgacaagcagttttttttttttttttttccctctctgggctttagctatatcctttaaagatctttatgtatctggattaagtcacttgcagcgaagtgcttttatttattcattatgttgcgctttatcaaatatattttagcgtccatcctccctccctcccaacgttttgaccattgcagttgcaggtaactgcctggcttatataggcttgtttgcaatgtcttaatcctttagtcaataccagagctgtttggaaaatgttagtgctaaaccaacgtgggtgggatttagccaatttagtctccttttgagtttgggatggtagaggagcagtgtaatcttgggtctttatttaaaatgtttgatgacccctttaactattttggctgttgtcaaatgacaaacatcttgtttatcagctgttttaaaaatagcactttgactttttggtttttcccttaggctcgtttctacttgtccttttaaagaattaaattctgaaatatacaaaaattgatataatttaaagaattaacacatctggtgtcctcactgaggttaagattgatagattgttaccagtactccacctcaacaaatccaacctgaaatatggcacaaaatattacgtttcccaatatgttattctgatattattaagtctttgtgaccttgcaaatcacacgtttaatattttgtttctgtatgttaactaaggtataaggaataatgttcagtgaatccttagatgctacctatgatttataatttaaaagtacaaagtatttttggtcataaaatgtaatctcatatggaagtaaatattcctttctagtttgggaaagaaagtattaatgggtgaattctaaaaatgccaattctgcacttgatgttaacttgaagatatacataacgtgcagaacactctagtgctttacatagtttcaagcatttccatttttaagttaaatataccatatttttacatttttttggtttacatttctaactttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacaggtaggagatgttggggtacctgctcgtgattgctgcctctgggtgctgagcttgaaaaatgatacttaaatatttgaacttgaaatttttccagtaccgggtttcaactgagccgccaacgcacatctgctctcttgcccacttgtgacatgcccagctgccagtttttctccttccttttgtggtggtggttatattatcagtatgactagggaccttttctagatttttctatctgggtctgctgctttctagactctgttcaggtaataaattattatcaatgtatatctgagcatccagtctccctttcatgagacctgtcagtttgagggactgaaatgctcagaaatgatggttatgtatgctgtggcaggagatgcatacctggagtttcattaagttgttatggtgtgttgcttttagttaatcagttgaattaatcaaaagggaagaatttgtgttcctgtccttttaataattgttattctggcatatttagacacttaaagatgtgcatcattaaatcttaaatggaaaatgagactcgtgcacatagctttccattttttatcttaatgatcatgatttccaatgtggtgggtttttttttttttttttttttttgagacggagtttcgctcttgttgcctaggctggagtgcagcggcgccatctcggctcactgcaactctgcctcctgggttcaagcgattcttctgcctcagcctcctgagtagctgggattacaggcatgtgccaccacgcccagctaatttttgtatttttagtagaaacggggtttctccatgttggtcaggctggtctcaaactcccgacctcaggtgatctgctcgcattggcttcccaaagtgctgggattacagacatcagccaccgcgcccggccaatgtggtagttttgtaacaagactctagttagaatttttttcttttttttgaggtggagttttgctcttgtcacccaggctggagtgcagtggcgcaatctcagctcactgcaacctccgcctcccgggttcaagcgattctcctgcctcagcctcctgagtagttgagattacaggcgcctgccatcatgcgtggctaaatttttgtatttttagtggagacggggtttcaccatattggccaggctggtctcgaacacctgacctcaggtgatcctcccgcctcagcctcccaaagtgctgggattacaggcgtgagccactgcgcccagccaataattttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttctgttgtgattaactttggataaattctgataagtgtttgcaagttaattgattttcaaggaatggtggataatgggtcttaatctgtaaaatctgtaatataaaatagtttgaaacaagatgccactatatggaatgatgtgaaaattaggctacaaaatttcttcctcaatatcctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggctgtactcatactcctgggctcaagcagtcctcctgcctcagcctccagagtagctgggactataggtgtgtgccaccacacccagcttctaaatttattggtttttgaatggatacagtgaatacctccagttagcactcttggaggtagcaaatgaaactaatttcttgtctatcttttctgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtgaaagagtagaatgttaaggtggtatctttggtaaccttggtaactgttttcaacagtgtttatctttttaagttaatagatatgtcaatttagaagttgttctctgtgacttgattatagaaattatctttgagacagctatctcatttttttcattctgaattatcttctataattataatgttgggtgttttcataattttggtaagattttagtctgtcattttttttttttttttggagacggagttttgcccttgtcacccaggctggagtgcagtggcgcgatctcggctcactgcaacctctgcctcctgggttcaaacgattcttctgcctcagcctccgaagtagctgggatcacaggtgcccaccaccatgcctggctaattttttgtatttttacaaaaacaggctttcaccatgttggccaggcttgtcttgaactcctggcctcaacagatccgcctgcttcagcctcccaaagtgctgggattacaggcgtgaaccactgtgcctggcagtctgttgtatttgaaggtgttattgcagatagcaccttgcagtgacagcacatgttctttgacatggtgactcactagagttgcctatacctggcaattccttttgcaaattatgtataaaattgtcctttctgtaacggctataaccctgagttgttttaaacaggtctgtttctgaatctataggttgttgaattgttgcttgtgctttgattgtggatgcacagaatggagagctgctggcatcctggccatcatgtgtgttcctgtcatgttatttgttacttgttactgctgagcctctcttatacagctgcactgtagaaaaccatatatttcgattcttctctgttctgctttctgttgtatatttcgattcttctctgttctgctttttgttaaggttgctgtgcaaatgtcacatttaaatatgtgagtgcttattgtgcatacaatgctttgttaggaaatggggagatgtgttgtgggggaagttgcgggttataatataagacaggacctgacccgtaaaggaaaaaatggtgtaagttccttggatgataattgttggagagtattaatcagaagatttcctcgagtgggtgcttatgacctaagcattctgtaggaaggtaaatagcaagtagacttccttggctgaagtggtgagtcaagtagtaacaagaagtgaatgtagtagaggagagtcaattggaagatttataaagaatagagaggctgaggagtttgaatttaatttgagaggcaattgagaattactgtaggtttttatcgacctgattttacttcatatgtatgtacgtgtctagatgttgtggctggtgggggtgggaggctctaggaggaaaggcaggaaactgatgcaatcttaggagaaatagttctacaggaaaatcttgctcatttctatctccttttattctcacgattttcccttgtatacagtgccctcctcctttgtctattaaaaccctactcatccttcaaggcccagcttaaacttctcttatgagctcatcatctagttctcttaaaattctttactactgagtgggcatttagtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagcattgtgttaacttgatatagtatactgtaatggatctagatgataacaaaatatagatatgctgtcaggacttaagtggcatccatccaagagttcatagaaactagagggtaataaaattacgcaacagctggctactatgtatggccattacagtcattgttggagaattattgcaagacttctgattattatgacttagaaaaggcataggaattggtaaaagtccaaacatgtataaccacaattatcaagtagtagaaggagcttgtatgcatggattggattatgcagtcatggtctgccaaaacaggggtaaccctttcagtttagaaaaaaacataaccatacaaagtagatagcaagattatataattcattacttctgagagtatagtgttaaaaagtgctcaggctaattagaggagaagtcaaataagattaatggtacctttgatgttttgaggattagtattagccttttgtgcttgaagtgatgggagacaaccttactctctagaacatcagtcattgcttgaaggacagtattgagtcagggagatgatggaactgacccagtatggctgaccgtaagattgttgtgtggcagcctgtactttgttggcagactttttggttcacctgatggatgatactatacaaccacaaaagctgtttatcagtagaattaagtgattttggaaaccataatatagttccagagcaaatcatatatatgatgatttttcggcacagttgacaaaatttcactttctaggacttaagtctctttcacccatggaacagtttggaataataagcatacttcctgttgtcattgtttctgcctgttgactggtagatgtgactgacaatggcaaaatagggcaaataaaaatttaagctcactgttgtgatgagtgtctcatccagatgaatggactgatgagtcagatgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccaggctggagtgcagtggcacgatctcggctaactgcagtcactgcctcctgggttcaaccgattctcctgcttaagcctcccaaatagctgggattacaggcacacgccaccatgcccagctaatttcatatttttagtagagatggggtttcgccatgttggccaggttgatctcgaactcctgacctcaggtgatcctcccacctcgccctcccaaagtgtggggattacaggcatgagccaccacgcccggcctgatatatatatttttaatgtgactgacatttggggaggagagaaagaagctctagtaaggtcccatagtattttatgtgaagctaatggggccaaatgcatttcaacattcagaatttttaggatattagaaagataataccatatataaaacacccagaaaagtctggagcagcaccttttagtaaaacacatttatatttctgcagcaaaagacagtattcatactaagtgagataattaaattctataaatagtttcatgtcacctcaagtcaggtttaaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgc

SEQ ID NO: 1095 - DNA, 13944 bp, mus musculus; identical to SEQ ID NO: 1094

SEQ ID NO: 1096 - DNA, 2003 bp, mus musculus
ctggggcccttctaagaggaagatggcccaggagaagtctctagggggtgcctctcaactggccctatggagaccctttcctgcctgcggagagagactctcagccactcccccagggccggccacctcccagccattgcctggtgtgcggccgcaggggatgtccaagaaaccccaaaagcctaagcacagcagccctgggaagaaaccagcaggaaggaagaccagggagtcccaggctgtggcgagagaagataatgacccaaatagagatgaggtcccaagggcccaagtaagtaggcccttctcaccctcctctccctcttcatcctcctcctcctctggtctccccccagcctcctctcttccagcacacacctgtttacccatgccccctatgtcccttgctcaagggttgttatcggaaggccagggacactagaatgcccaatcagggtcttcgttgtaggggcacacgttaaagggagtacttggtgtgtgacgggcaaacctccggacactctgcaggggtcctacctcctcccccagagaggagctgggatggaaggcagggctggcagctggttaggttggggtgatcccttaaagtgtgggccgcaaacctggggcatctaggctcatcaacttcccgactcctccttacttagctgttgcccgagccacctggaaaggggcccaggctatctcactatccccagtgttttccctggctgggctctgcctcctggcctggggctgactgggggagaaagtgctaatgagattaggctctggagtctccatcttaccacaacccctcccatatgtactcactgcccgcccccaccgccagcccgactcagaaatttctgttttagcttcccacacaccggccaggactgcctcgcctatccacgcatcgtggagaattcagcagtagcgactccaacatcagagctccccaagttctggggacttcagagccctctgcctacagcctgggaggcctcgtgcccagacgccatgcaccctctggtgagtcttgcgggtttgataggagtggaggggagaggggtcgggagggaaacctctggctctgtcgcttctgggggctcagccttgttcccaggcttccctgcccacccaggcaggtatcccatgggaaatggggtgtcgacagggctggctttaagccacatcatcctctctgagtggggtttgtgtggtggggggcgatttggagcagcgctccaaactccaactctggaagactttcggcagtactgagcccttttctgttaagtcctgctcagccacactggccctccgagggcctggctgtggctgccccactgctggtgtccaacccggagtcacaacgctagggggccacaggtgcagatgggctcatactggggaacagggaagacagtcacagagggagggttggagatgctgggcagagcaggggcaacatgttgccagcagagggtgatggtgcctcactttagaccctgctaggccttttccacctcactgggcggcttggaagctggattttgtgttctctttcaggtgactggcagccacctgtccatcccccaagaccggaaaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactaggtatgagggagccctggctg

SEQ ID NO: 1097 - DNA, 2003 bp, mus musculus; identical to SEQ ID NO: 1096

SEQ ID NO: 1098 - DNA, 242420 bp, mus musculus
agtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaaataaatgaacattgtcatgtcttgcccttttttcttccctatgcgttttcctcctaggattcccactcccttactgaccattttgctgggggtcagcattttaccctgcatatcctccatctgtctggattgccctcagattcttcctctagctatttattttgaccatggggcaggagaaacctgggaaggtgggaggaaggttggaaagcaacatggccagagtgaatgacagctgacaggccagcagtatatagcctccctgcagtgacaacttggctgccactgactgagtagtggcaagtcagactggcctatagcctgcaggctgggctggggccctgagaagcagcaggggaggacagagagaggaggagcgagatagaggaggagaaagtggatgctgaagaagttgaaggtgcttctctacacaatcacaatcatgggtcatgcccccaccatcttcaaggttacaggggtggactgggctaggctagttgcctcgcaacatcccacccactccactgaaggctgttctttggtaacatgaacccctttgagactgccctaaaagctcttgtaactggtatggtgtgggagatggggatggaaggaggagacggtagaccacaggactgccgaaggcccctgtggttgtggatctgtggcagttgccacaccctaggcatggccctgcctataagttgaggttttccccacatctggttttgaatgtgtcctgttttatggcatctgtggcctgtacactgggttcttcatctaaaaaatggtgtagtcaaagccattgggaaatagctccatgcctgccaccatatgctgagtcaatctaagctttccaacttctcccttggagatctatataatgtttgtaggtgcttagatgataattacaaaagcaatcaggccatccgcgtagggatataatatctcctttgccatcaaggaagtcactgaagggctagataattctaggtatgtttaataacactggaaaactatcatgttacactagctcatgaacttgctgtgggaaagatgttctgttgcttcttacaattattttggcttgaatacagccagttgggtccgtggtgaaaactccctcttcatctttatgtaaaattcctacttcttgattttccaactttatggcaactctggctccaaatcagaaaggacagctggtttatttgtgtttaaatcataattccagtgtgaggatagactgttgtaaatctatacggagatgaaaaaatgaaaaaagcacctccagactgcaatgagtttgccattagatgaggtgttgtggaccctgagtctgaccgtccttgctaatgaagagaagagatggcctcttgagtcagatggagtggggagggtggcaggaatttggggacttggaacaggcactcagccagggcttactttgtctctgtggtacgtttcatcccgaggctcttgggacagagggttgacagagtatggagggagaagcaaacccattttcttttctcttcccaccccaccctgctttccattttctttttaaataccatgaaattcctggtctgcttcatggtatttccatgtgttgaaaacatcttccctggagatttggataccaaaatgtccactagaatttcttccactttagaaacaagacatttaatcttctcttttttaagacacatgaatagctaaagtgataaaagtgtcaggatgttggaatagtagagtaataggagaagattcaagttatggctcttgggctcaaccttgaccttgacgacattgattaggttttaggaggagagtggtatatttacatcatctgttcctgtacctctctggtgtggtaccaacaattcagtcattaaccaccatatgtgtcataacacttgacatcccggacccagaaaggggaaggtacctgtccaaaggcacccagctggatcaagaccttcagtagtcatgagtgctgaaaagattttagtgcctccccatatgtaattccaagtgaaagcaatactaaacctttaaacaaaaatgttactctttttaaatggctcaaagctcacatggatgttgaaattaaaatatcttactagattctttctcccttcctctctgtcttttgtacccctgctgttggtggcctaatcatgtatttaatctgctgatttgggaatgtggtaccggctgggtcacacagcaggtcagtgacaggaggcctccacctagaagccatgccttctgacaaccagactagtgctctgccctctgcagtgatgctaagttcaaagtcagttgttcttcgagagtcattttcttggcattttctctagttggaacttgtccaggatgagaaataactcctgttacctttagtaactgagggcaccctgtggttctgtagttgtggccgggggtgagctgaagctggagaggagaaaggaaggtcaaactttctcatatagagaatatagagaataggtgtgaggcaacaggctctcttgttaaagcaaaacatagtcttctttgaatggaaaattgctccagaaaaaggatcttcaggtgggaaggggtggctggccagtgaccctgacactgttgcaatccctcctgatccctctgccatctttatacctgttcttctcccttgtagctttcaatccagttgtagacactacttgccacacacctgcatcctgactattttctgttattctagtagaggctggttggcatttcagaaggcaccttttattaaaaaccaatgggaacaagaaagtaacattattaccaaaagtgcatttagcatacacatttacagggtatggatttcttatccttcagtgctcaagtagcttaacaggctcactggctttgctgctgtattccctttctgaaggcctcaaatcgtcttttccttagatcattattttctagcctcgaaaagtgggcacaactgcgtctggaccctgtctgacctttgtgctgggtgctaaagacccagaggtgaataagacccaatgtctccattcgaggagctgccaagctgcagaggtaggtgccatctcattcctgaccacatcagcatgtggtgcctgggaatcaggtcttatttaggtggaggagagctgataaccagaaccaggaccctagttcacataccagaagattcttctgctcagtccggtttggcgtccaaagatggaatttggacttttagaattccctatggtaaaaacaaaaataaaaaccaatctgtcattctgttagtgttattgtgaatttagcaatgcttttaaatgaatttgcagttttaaacactataatgttatcttcatgcatatgaagagtagtgcttattcagtccatagacaatgcttggtggatctgcaaactaacagacttcttgtgataactctatggtcctctagagtcctctactgtcagttgggaatcgctggccttcctggttcaagctatcagctctcccctgctctgtggaactccacaatttcactcaaataagccctcattgaagttttcaagttagagggcacaggatggcaatcttaacagtcaagactactttaataatgccacaaacaggaggtatgtttattaagtgtacaggtagtttgcagtaaagtgctttgtatgaggtcatgcacaagaccactaggtatcagccagttaacttgggaggtttgagcaattaggcagctcttcctccctcccttcctctctccctcccccctccctccctccctccctccctcctttcctcccttccattcccttcctccctccctctctttctaaaatgtaagctcctcaataagatataagctccttgagggtagtagtctttatctgttttcactgttgtgtctccagctcccaaaacaatgcttggcacctaataggcacttaataaatacctgttagattgaataccttctttctttctttctagctatcgcacactctttgagtacttgactctgggccctgccctgtgctgatttctgggggtacagagtagaactaggatgcaggcccacagtccagtggggagaacagtgagccatagtgctgtggagataaggtctaggctaccggggcaaggcagaggaggcacacctgactcaggacagaggctgagcgaagcttccaggaagatgtgatgtctgagttctgaaggatgatctggagctggccgttgaaggttgaagaaggtgggggaaggaattcctggctcaggaagtagcctgtgcaaagccctggatatgtgagagagctggtgtgggggaggaattcactgccagtgattcaggaggagagggagcaaggcacctcctgactcagaataagcccccagggtggaggtggggtgggaagttcctcacatcctgtttgttcgtcagggagttggatatgagggtcttgagaaggttaaactgcatggttcaaatgaagttgtaatattaactaactgtggattttctttatctacactcaagttttcattatccttgggcagatgagacccaggcaacctcggctccttcatgctttgcagggccaggccctgggcccctctaaaaaggctagacagagcaggaggggctccgagccacagtgagaaagagagagaaagcaagagtctacctgcctgtgtgtccccggctgtgtgtatccagttgcactccaaagctaaatgtattatttatgcccctgcttttctgtgagtggggaaatttgaggcttgacgatatcttttattattatttttctttctgaatagcatagattcttcagaatcgtctgtaattcatcaaggggaaaatcagaattttttttttttttttaaaatggactcaaagaggagatgagtttttaaaaaatatctatcatctgtttttattttgactggaatcatttgcttccgagcacagtgtaattagctgcctgacaatttatagcctgatccccagtaactgaaaaataccaaactcaaattattcccccagactaggaggcccggaggtgattgaggtctccttacgttaacatcctctgtccttgggggctgagggggagggcagttctctgcccttgcaggaggtggtatctccgagttgtcagcaagacaggccttgttgttatacactgagtgtctcctttgactcagtaattccatttccaggattttatgctaaagaaataatcagatattgtggggggaaaaatgtgcagggaacccccactgcattttttggttatttgcattagccagaaaaaggaaaataacttacacattcaataataggggagtggttatataaattttcctaggtctatgtgatagactaatatacagccatgaaaagctatgctctaaatgaattataaggctacatggaaatgcacaaaataatgctgagtaaaaaccaaagataaaatttactactatatacaatatcgtctaaaacagagcacccacacagacacatacacataagaagaaactggagaagcctatgccaaaatgctgacaatgattatctcagggtgatgggattatggggatgagtggtagtattttccttctaccattctgtatttgtcaaaatttccccaatcaacatctattacttttagtaaatagaaaagacaatggatgacatgttaaggaaaaggatctttggatttggaatcgtcagcttccaggtgaagtcccacttgcccagcacctactatctgactctagtgtctctgagccacagttcctcatctgtaaaatggggttaaatactacccagttcacagggttgttgtgaggatccaaaataatgtatgtattaatgaaatgcctggtgcctatgctgcaaccatggacaccatcactaaatactaagaaggtgaaattccacgaagcttgctgaaatccctggatgggggtactgtcaagatgaagttataataagaatgttcctagacagctatgaattgcagccattcttcccttttccagaatatgtaaagaatgtttgtgtgcccacggaggagccgcatctagcctttgaggctgtcagctcatctttcccaacccgaggattttcctttcctctgactcctcccttcattctcccccactgacatctgttcactgcctcgccaaccaagggggaaaacattctttggaactgaagctgaggcaccaccaagagtcaaggcagctatgagatgtttattgtcacagagaatatgtggtgctggctgaccacagaacctgccaggctgggatgccaaggagggactttaatgaagcagcagaggatggatgcaagccgcatagccaggcagtgtcccctgcctttgggcagagctcttgtccaagtgtctcactggctctctgttttcttccccttgggatgtctgcatggctcctggttgagctcaccagttttacagaaccagcctggtttatgggtgaagaaacaccttctcacagaacttatggggcctaagcgtgtttcagtaaagtactgggcagtttgcctgagggcccagcatgcctaactctcaccagcgtggatatgaagcgaggaaaacctgagctcacagccaggcagcctcaaggacataggcacacctcagcagtgtctacaagatgccctggccaccaggcaatccagccatctccctgggtagaatccttcacactgcatgtctgattgcatttttcattttttaattacagccgtagactcatatagactctgactgccaatctaaagcacctagagagtttttttaaattgttaatgttttgctaaattcttagtaattatacaaaatcattatgtagaccaatagatattattgaccaagatatagtgatgcttaaaacaaagtcctctgtaatcagtacaacatgttggtagaatttaccctaaatgttaaaaaaaaaaaaagtactaatgctgtggctccaccccataccaataaatccagaatttctgggggatgaggcccaagaaacagtactatttaaaagttcccatgtgattctaccgtgcagcttaggtgaagaactcctgttatagatgttaaagctgggagagacccagtttcctgacttatttgaacacgcaatcctttacaaattatacttgtggataatgagcatgaactatgatgcagacttagattaaagtaagtgacaaaaaaaaatgatctcgcagatgaattaattgtaagcagtaataatgcgaggttaggttacatatatattttgtttttgttttttttgagactgagtcttgctctgtcgcccagctggagggcagtggtgcgatctcggcccactgcaacctctgcctcccaggttcaagtgattctcctgcctcagccttcctaagtagctgggattacaggtacccgccaccatgcccggctaatttttgtatttttagtagagacggggtttcgccatgttggtcaggctggtcttgaactcctgacctcgtgatccgcccaccttggcctcccaaagtgctgggattgcaggcgtgagccaccgttcccggccaatatattttttaacattataagagaacataggggttgggcacagtggctcatgcctgtaatcccagcactttgggaggccgaggctggtggatcatctgaagtcaggagtttgagaccagcctggccaaacatggtgaaactccgtctctactaataatacaaaaaattagccgggtgtggttgcgcatgcctgtaatcccagctactcaggaggctgaggcaggagaatcacttgaacccgggaggtggaggttgcagcgagccgagattgtgccattgcactccagcctgggtgacaagagcaaaactccgtctctgaaaaaaaaaaaaagagagagagagaacataggaaattagaaacatgaaaccattttattttattaataaaaaggataaatatatgatgaagtagagtaaaacatcttttattttacatattttggttataacacgtcatcaaaacccactaacattttaaacaagaatagcatttttgttttcttacgtcaccgccacttaatatcacccatgatgttactgggttggatccctacaccaggtcaatctcaacttatttttctttgcaacagaatataacgactccactatgcacgagttcatcggagtataggcaagaggaaagaaacttccagtcgtaatatttagtgttctgaaataggctgtgccagaaattccaaatagaagttggaatggttgcctccaaatcaacgtctagatcagactctgtgctttcccgtgttctctgatgtggcacactctttcatgcaggtagattattgtgttaataatacggcataagagtgaaatgtattatccacatttgtattttgtatttgtatccacaaatataatttgtaaaggattgtgtgttcaaataagttgggaaactttggagtggtctctcccagctttaaccatctataacaggggttcttcatcccagttgcacagtagaatgtataaatgtattgagtatttttaatcccatttatacttcaacaaatgcaatgcagaagaaagagtatttatcttttttcccttcatgatcgcaacagaaatagttttagaatgtggatctaggccaacactcacccagagaaaggaagaggactggggcaaagggatctctgggtaggtggctgtgtgtttggatttccagtgcagaacctctcttgtggctattttggggtcctgagacatccacttatgtgaccctgtcagcagcccccctgggaaatacgaaggcaagggggacaaagggaaagggagaactatggggggcacttttggcatccctccatagtgtgatcagagaggggagatgctaaaggtaacccctatagtttgcctcccaagcaatactgtacatcgaggatgataaataaggcatcaagaataggctgtaggtgggagaggtggcacgggcctgtagtcccagctacttgggagcctgaggcgggaggatcccttgagcccaagagttcaaggccagctggggcaacatagcgagaacttgactgtatttaaaaaaagaaaaagaggcttcagcatcttcagaggaatctgtttaagaaggctgagaagggtgtgttcaggaagagttccacttgaaatgctgaaaattgaagaaaagattaaatactgaaaagtgggaaacattccagctcccaggaaacttacccattaagagaactcatttcttgaggattttggatagcaaagtctccctgtattccaatttccagcctgtattacctcttggaataaagagttacataagtttactgcctgttgcgaaatagcccaatgaaatcttttttcccataattctgagttaatgaaaatggtagatttaggaaacaaatgttattggcttgcacagaagttttatattttgtgtctgtagcttccagactacctaatgcacatggggtgtggggtcatgagggaaggggaagagctagtgaaggagaaggttctctttgtcctattaaatatttatttcactctcgtaagatgccagagggagctggtagaaatttggcaagcaggtgtcccctccaggtagagggatggcaaagggtgctttccctgggtggattaattaggagaagccactctttttggtggaatctttagacaggcacatcctctgggaacagcaattagaaaaagtccccttttctggtaataagtattaaaatatggagtatcctctgggtggaccaattttaaaaagtcaccctttctgggcatagtaactagataaaggtacttcttcctccatgtgcagtcagacaaggcattgggcttggctgaattgtgtctccaacttgagacccctttgcagggtacccttgtaggaatacaacttgcccaacagtataagtggtcctgtagtgccaggtgccaccaggcaccaggtatacagaaatatgtcagtgatataccctgttcttggataatttataggacagcccctctaaatccccactggctttaactcgccccatctgctgccagctccacccctcctgcgtccctgctggcagagctactctctatggtgatgaaacatccaccctccagatgcccaggctgcaggctgttgtttgacgtggctgtgctgctcctgtctggggatccaggctaaatgtctgctttccacaatgaacagccagagttactggttaattgtggtggctcattgcttctgggttctagatgggaaaacatggaaatcatttaacacttcactatggctttaaaacttttctgtgttctgtttaaatgggctttgaaatggtgagttttggtgtagctgagatatttctgccctttaattttcctgttctttaataaaggaaagcagtttatctttaatctggtgatttagagctgactctgaggggtaattcctaccccactcattgtactataactttgccaggctttttgccaggtattggtgataccaaagtgaaaagacttaccttttgctcttcagtcttagcatttagttggggagacagtatggaagaagacaactttgctgcagacctcgctacagaccctttcacatagggtccaatgtgaaaagcacagagtactgaggcagggaaggttttcatagcattttcctctcgtgtcttccggaaaactcttattcattcctccagatttctattcaggcattccttcctgtttacggccctctctgactcccttcactatgttcctgctatacttttttcactatgttcctccaggtagcctaccctatgggtaggaggcagagactgccagtatgtattgaccatttttgaattcatgtttatttccttcttttaccacctcttgaaaagtaatatgaccctcttctttagaacttgaaagaacaccctggccatcccttggcctaagataaactggaagctagaagttagaggtctcttcctaggagaattaaagcccatcttaaaggttgtgaggatttggaaacagagtagaactattgaggccttctgatcccaatacatttagatgaatataaagagttccttctagctcaagggaaatcagagttacattaggtggttgtaggctagtgacgggcctttgagagtagaaagagccctgattatgaacttggcttactttgctaattttgcccaatgtaagcccaattccagtatttgctaatggaggtaatttttggtgttgagcctctgttttctgtttgtcaggaggatcaaatgaaagcctgtatgggaaaaggctttgtaaacaaaaaatcaccccccctccccaaatgttatgtattatcatcttttagggcaaggatagtggctgactcattcctttttcttcaaaatctagtttggaagtaggcacactgtgaatgtttgttgaatgattaactggcctagtaagagatgagtttttgtgtttctttaaagctctgcatgttatctaataaatccgctatattagttaatgcctacccttagcttttttggtaatttttgccattaccaatactgtgaacctcgtaacacccaagaggtggttattgactcctagatattttgcctgcaataggatataccagtgccaaattgacagtggtgtctgggctgatgcctcttgtcttaagagcttaggtttcccaccagactcctcaagggttgtattttattcctgtctgttttcccccactgccctggtatgcagtaagtgctcaatacatattttctgagtgactaacagagagagggagtggcatgtttttgcacttttttttttttttttaagacggagtctcgctctgtgacccaggctggagtgctggagtgcagtggcgcgatctcagctcactgcaagctccgcctcctgggttatgtttttgcacttctatttggccagccaaataaactccagatagcagaaagtgacagatgtcacagctagatcaccctcatcttacttttatacttgagatgacactccttttctaatttaaaaaacctttggacaaaaacccatgtttttattgttatctttaagagctttctgtgtgcctgacaatatatacatcattaactcattttatcctcacaatgattgcatgaaatagttaccattattatctcaattttcttgataaggaaacaggctcagagaagagtaaacaatttagagttatggagtaagttgagcatccacaatttgaatgcccatccatgttctccatcacaatcaatggggaatagattttactgaaagcaaggatcagaaaagaaatgtgtttttaccactatcagggaggagattttgttcaatgcactgagttgggataggatctgatggagggctttctagtggattgcaagagattcagcaggaacatatccaatgagattaaaaaaagagttaaaatgtctgggggggcacagggagaaaaaacaggaaattgagttttctctgtgaaattaactagcatttttgcctttctttctaatttatgaagctcttttacatttgttatctcatgtgattcccatgacaaccctgtgagttattacttctatttgagaaatgaaaaaaatagactcagagatattaaaactgacctgcccacagtggcaagtgggaagtgaaaaccaagaaaccatttgcactgttttaggtggtggagatacaggagtgaacaagagaggccaaaatatttgtcctcgtggaacttactaggtagataaactatgacttatttcttttcaattaccctctgtcaagtaatagatactggttttggttttcaaccttaactgtattttagaatcaccgggcacactttgaacaaaacattgatgtgtgtgtgtgcacacacactcaaattttaaacctgctctcgggggttttagtgtgcaatcaagctcaagaaccgttggtttagagcagtggttttcaaccttggctgttcattaaaatcaccttgagaatatacatatatatacatacaccaatgtctgggctttacctctgaggctaattaaattaaaatctctgtggttgtgtccagacatgtgtacttttaaaatgtgcctcctcaaatggtgctactaagttcagggtgtggggtttacatgaagcacttgagataaagaatagcttggtcccatttcacagactgtgcccctcacctcttgagcatatgaatcatcggtccttcattcttgcaacaaaatgtttattgagtacctgctgtatctctggtgagttccttctctttcctgggtcctgattcctccctttgtaaaatgagagactggggtgtctctgagacttattgcagctcggtctataattctataaaggagagtgggctgggaatgttaatggctcagaggacccactcttggagacccaggttaaattatttgtcctcttgacagtactgtatgcttcatttgagagacagaaattcatgaaattccaaaaatacgcgagcaagccttctctcactaagcagtttgtccacaaggagcagatggaatcttcttccttcgtctcattcaccatcttgctgaccatcgggttggcagcacaaatgtgcatatgagggccggatcagagggagggactcaatggggtcaggctgtgaaagtcagccagagggaacaagaaccaaaaatgtgccttgaagatcaaaagcacctggaagcagcagaaagcgagctagaggaaagcagcctaccacttggcctaattttcttttgcacctagagttggtttaacactgacagaagacggataataaggatagctgttgagaggtagcagagttagcatagcagtgaagtgcttgggccttggggccaccctctctgggtttgaatcctcactctattacttgttttctttcttttttttttttcttttctttttttgagacggagtcttgctctgtgacccagacaggagggcagcagcgcaatctcagctcactgcaacctccgcctgctaggttcaagcgattctcctgcctcagcctcctgagtagctagattacaggcgcctgccaccaagcctggctaatttttttactttttttagtagagacagggtttcaccatgttggccaggctggtcttgaactcctgatctcaggtgatccacccgcctctgcctcccaaactgctgggattacaggcctgagccatcgcacccggccctactacttgctttctttatgaccctggacaagtagcctgacatctctttccattagtttctctatctgtaagttagggatcattataataatagtacctactttatagacatgttatgaagattataagcctggcaggcattaaatatttgtcacacaaaatttataagtaatacttctaagtgttgagcactttacttgtatttgcttcttaatctttgctttatttgaaacaggtactattttcccaattttgtagatgaagaaatccaggcatggagatgttgtcactgtgtcattaactaagttagtagttattgcaaaaaatgagctaactagtaagccacagagccaggatttgaccctgggagaattgattctttagtgcccactcaactgcaggattgtataggactgcacacagccattatcttaggcttgatacctgaagataaaggaactgaattgggccctggaaatcctgaaaagggggaaatatgggtctcacccagaggagttgactctgtgggtagggacagcagacatatgcataagaagactgcaataaaagatgctttgtgcctaatgtcatgggagttcaaagtggccagtgacaggtttgttgtgatgcttggctttggactggatccttgatggacatacagagtgtgccctgggcaaggggagttgcatgagcaaaggcaaggaggtaaggctgtggatggcatttttggagttggggaaagcactgtttcccctctaccatatggtatagaagcctgggtggcccctcaaacttggtgccaaggtcgaggggcacctggtactactgggcctctttttgggaccccagggaagcagatggtacagaagcataaacttgggctgtcataggtggtttggacatccagtccaaacccttcatagcatagatagggaaactaaggcccggagaaatgaaagacttagccccagcaagccagcagcaaactatggaaggttttgtcaggccaatatttctgccatgcagtgatgcataagagagcctgggccatatcctggagatataattgagtagcacacaaatctactgtagtacccagaagtcttcttcggaacttgattccaagttttcttctgcttaactccccatactgtcatagatggagtcttaaacatgaggtttggcagacctaccgtggaggcagttttacagggcaagctgagaggaagacagggcagggacccaacatgatgtgaattatcccctaagactttgaagttctcaggtgttttcataattgttttttaagcatgagataaaatacctaggcttacaaaggaaaacaatggtactgaaagatagttatcaaaatactttttaaattgtgatatatagtagtatatgtgcttcttagcatatttcaaattacaagatctagcgctgggtcttataattaccaaaatattgaatgagtgaaatttcaagataccttcaacaactgtcatatgatctgtgatttctattactgacaaaggcacaggtattgctaacacttctgtggtttgttgcctacattcatcatttcaattagagtttagtgaaaataaacagttaattattttcacatacaagttcacgggcctcctgaactctcttcatgtaacacctggttaagaacttaatttaactcattaagaatccctgtcctaaggcaaagccgaagctggagaactgacccagcatgggatcttaatcctgctctaagaaattgacttgaaggaggtgcttgagtgccctgaaactctactcaagattgtagtgtgcatggatggttttcattagtgcaactcactgagtagttctggctctctttctgtttctttctcttttttttttctttttggcggtgggggacagtgtcttgctctgttgcccaggctgaagtgcggtggcatgattatggctcgctgcagcctcaacctcccaggctcaagtgatcctcacccctcagcctcccgagtagctaggactacaggtgtgtgccaccacacctgactaatttatgtattttttgtagaggcggggttttgtcatgttgcccaggctggtctcaaactcctgggctcaaacaatctgcctgcttcagcctcccaaagtgctgggattataggcatgagccaccacgcccagactctggctgtccttcttccaggaacatggcaggattgcacttcctcacccccttgcaattaggggtggccatgtggcttgaacctcatcatattcagaattgattccacattctatctgccctgcccacctctcttacctcacctcccacccgtttcaccgggtctacttcagctgtgctggcctcatttctgttcctcaccaagcttattcctgcctcaggatccttgcactagctgttctttttggctggaacactcattccccaactcttagtatgactggctcattcttagcctttagaactcactgttcaccttatttttaacagctttattgaaaataattcacataccatttaattcccccatttaaagtgtataattcagtgccttttagcatgttggtggagttgtgcaaccatcaccacaatcaattttagaacattttcattaccctaaaaggaaattccattccccttactggtccaattccccatcttcccaccagtccctggtaaccactaatttactttgtgtctctatggatttgcccattttggaaatttcgtattaatggagtcatataatatgtagtcttttgtgtctggcttctttcacttagcatgttgttttcaaggttcatccgtgctacagcatgtatcaatacttcattattttttatggctgagtaatattccattgtatggatggaccatagtttgtttatccactcacacattgaagagtatgtttctatggcttgttcctatcctttggctattatgaataatgctcctatgaacatgtgtgttcaagtttttgtgtaaacatatgctttcatttttcttgggtatgtacctaaggaatggaattgctgggtcatatagtaactctacatctaacttttgaggaactgccagactgttttctacagaggctgcaccatttgatattcccatcagcaatgtacaagggttccaatttctctgcatcctcaccaatacttgttattttctgaattttttattatagccatcctagggagtgtggagtggtatctcattgtggactaaacatcttttcatgtgcctagtggccatttgtatgtctttttagataaatgtctattcgagtcttttgcccgtttttgaattgggttgtttattattttgttgtggaattatagttctttatgtattccgtatattaatccctggtcaggtatatgacttgtaaatattttctctcattctgtgagttgccttttcactttcttaacagtgtcctttgatgcacagaagttttttaaatttgatgatgtccaagttacctattttttctttggttgcttgtccttttgccatcatacgtaagagaccattgtctaatctaagaacgtgcaaatttacatgtttacttttaggagttttatagttttagctcttatattttggtttgtgatccattttgagttaatttttgtatacggtgtgaagtagtggtccaacttcattctttgcatgttcttggatatccacttgttttagcgccttttgttaaagagactattccttcctccattgaatggcattggtatccttgtgaaaaatcaattgactgtaggtgaatgggtttatttctggactgtcaattctattactttgatctatatgtgtatccttatgccagtagcacatagttttgaaaactttgattgctttaattacttttgattactttgtagtaagttttgaaattgggacgtgttagtcctccaacttagttttttattttcaagattgttttggctattctgggacctttgaatttccacatgatttgtaggatcagtttcttcatttctgcagcactgccttatttttgcccagctgtttactgtttatcaaggatatccacattcattttttctttcgacaaatattgattgagcacctaccatgtgccagacactgtgccaggtgctgtgaacaattagccatggcccttgccttcagggagctaagcatttagtgggagaagcagacattagtcaaataatcaccaaaataaattttaaatgaatgatagaaatgattgacttagtcgtgggggaccaagaaaatccttcctggagaaatcaataattaggaaggtgcctgagttggaggagatgtatgggaagagtattccaggcagcaagaacatcgttctcaaaggcgagaaaggaggatgcttttaaggaactgcaaggagacgaatttgatgacctacaagcacaagagaaagagcagcatgagatgagggcgagctgcctgagggggaccaattctacagggtctgtgggccaccgaagcaaagaagtaacatgatctgattttgatttcaaaatgctcactctggctgctgtgctgagaatggactggagaggggtgtgcaagatcagtgccagttaagaggatattaccgtagtccgagagagagatgagggagggctagatgaaggtggcgatggcaaccctgcagaggaggtggacagattcacagatgcaagagaaatggaggaggtttcagagtcagtccttggttcttgaggcctatgtgatggtgttggcaggggtggtcttcaccaaaataaagagtacatgagtgtaggtggctttggaggaatcattgttactgagtttgagatgccttccagatattattaagttatctgatcctcactccaaatcatccctatgagaaaggtgtaagactcttctcttcattttgcagatgaggaaactgagtaccagagaggttatcatggtttgcccagtgctggcctgccaataagtggcaaagccagaccagaatcctgttattctaagaacaacccttgtgctttttcttttccatgacaccagagctgactccctagaaaggcccatcccaaatagtttccaataataagtgaagatcactactaggacttctcccacagacaccaagtgtttcccagccctccacacctatgctcccagggaagcattggcctcctttttacagaattcatctctacagcattgctaccaagcccctccaggagtgtttagatcttccaagtatctgatttgtaaacctggatttgttgtttgtgcacagagagctacactgcctcttttcccagtgagagtcgccctgtccaaaagccttcctttttctctactgttagagacaagggtcacctgtcagtagtcaatgtatggaaagctgaaatgctgagacattgagccagaagatggatgacagaaagactaataatagatgacatgtcaaggtgcacttaacttttttttttttttatgttcaagtagaggactgtgaggagaaggaattgaacaggtggcaggaaatggggtgaaatgaaaaactaggagaaagtaaaacaaatacataaattcgaggagtaggaaaaagagaaaataaagtagtgaaagacataggttggggaggagatatcctagtttcaaatcaggctctgacatttattagctgtatgatcttaggcaagttgctcagtgtctctaagtggacataaaattgcactaactttatggggtttgtgtgaggattatagggagagcatgtaatatccttgccacagtgcctggcacaagataagcactcgataactgtcagctgttactatgacgtggaagcccttcctcatttctgctgcctctgcttcccccagctatccccaggcaggttcattttggccagcttggttcaccattccagccactgagccaaaatcccaactgaggcaggaaatattgcgttggcttcagcagacccaggagctggggaacttgtgacaacagctggactctgcattggttcctggggcttcttgctgccaatttgatctgcgatcaggcacctccaagagcgacccttggagatccatgctgcctctaggttgtttcctcctcccttcctttccttcctctttccctaccacccccaccatattgacttctactaaattctgcctactcactcttctttgtattccagttctcctccaggaccaaagtcctgtcctctatcctcgttttggtacagatttcctgactgctgagcagcctacttgcttgacttctttcatcaataccatgccgcttcccagggtttacataactaggtttgttaattgcacactctgaacattgtacttcactcagccagctcccttttccttgtagagcagtggttaagataatcctttgggatctcacacttctttaggactcagttgaagccataatgcctgctcccaaaatacacgtgaattcaatgcacgtggataggctaagttatgctccagtggccaccactatcaaattctcactcgctggaactgtccgatgtggattgatgggagggatgtgttcttcttagtcactcagtaatccaggctggtggagcttccctcttgaacatgtgcttccatggcatgaaaaagaggtataggatctgacttaacgtttttaaaagatccccctgacttctgtgtagagaatggactgtgaggcagcaagggtggaagcagggaggcctggaaggaggcctggttcagaggacagctgacggtgacttgagccacacagatggcagtggagggggaagaagtagatggattaggatctgttttggagtagagcagacaagattttctgctggattggagatggggagtaaggagaataaaagagtccaggatgacctccaggtttttggcttgaacatctggttagatggcgtccattcttaactagcatcaaaaccacagaatccttgactttgtcaagacatacctgagtgataactgaaaggagcctcagcttggacttcttttagggtgcccttccagctgttttgtaacaatataactggcaggaccgtttttttgtttttcaggcaagctgttcagtaaaggacactcatgcacacccacatgttcacaaacacacactcacacacatcacatgtcacacactgctgtggcagccctttctggacctcacacagcaccattcccgggagtccttcagggtctcttacatggtcctgtcactatttttgtttcttatacaaatcttttgctaatgattctcagtttaaaaacaacaaccatggctgtaccctcaaggagcctcatcctaggaagcagccctcttctgttttgtccctgggagggggtcagcagcaatgagtgacctaggtggtctgaagggccttttatcctatcagagtggtttccagcctagggaaatgtgaaaaccatagtagtagcacacttattaaaccaaatgtgctgctgcaccatcccaagtggcaatctgtggctgttaagtgcaattgctaactaaatgtgtagcctgttgcctaggcagctcatttgaaggagagggggttgtggaaaacgaaataaaatgaaagagtcttggccactgacctggttggttccaggcggagtcggttctgaggtacactctgtagctttagtgtttctagggcctcagggtgggagttcacattagtggtgtaaacaggtactaatgggttccattcagatgctggttgccaaactttctctcagaaaaggccagctgggcagcccttcaggctgtgtgcttgagaggggaagtggaacaaaaggagggccctgaggcagggaggggtgagccttagtacagccaggactgggaagctgcctgttggctaggaaaagcctaggggatttgtgagaggccagaggcttttcataaataggaattagggttctgtggaggggagtgaatctcactcctgcctggaaaaaggaaaaatgtgtgaggtgcctatcttccttcccaccaccattatctgtgtccctcctggaaagtctgaaagccaggtgttgcctatgagtgttttgcggaggtaaaggcacacacaggtaaagttacataaagcttctgtgagataggcatcataagcctatttgacagagggaagatggagctgcagagagagggagtgatttgcccgaggccacacagctaccaagtggctgtgttaggctttgagtcaacctcttgacacttgattaggggatactgcttcctaggcatggtgagaggcaggctgtgctcccgaagcctagagatgggagcaggaggctggttcccctgctctctcctgctctggggcccaccacctgtcagtcagcctgggggcctacgtgaccttcagggttctttccagcccttggagccaaaagctctctgaatctctaggcatgtttcccatccagaaatttaggcagtgggtcagtggatggcctctgaggggcctgccagctctgatgttctgaagacctggaaagagcaaagagcccaatagtttttaatgtgtgatccattgagccctagggaatcccacagaggtgtttcaggggctgccatgagcagttctgattctgtcttttatatattagagatctacagatgatttttgtttgcaagggagtgccacttctaaatacaaacaaagagaaacaaaacagaaactttaaagcccctgaactagatagtgaatgagagacaagtttgaacgaaggtgtctgctgtggtgagagtgatgatggtggtgtgtgtgtgtagtggggggagtttgaactggaaggaaaaagaggaaaatgaaaacaagaggaaagaatgaggttacagtttgggtcagtggtatgggtcagttgccattttgaaaagaggagaaagtagaaaagggaaagggaagcaacagctactgagtgcctacttgtgtgccagtttctctgcttgcatcctcactcataggatgcagacagcaaccccttgagttctaagtattattgttcctattttaaagatgaagaaattcagacccagagagtgaaaataacttttataagatcacatagcaagtaaattgtgttgctaggattcaaaccgagctctttttgacctcaaactctacaccctgtcctgttaggagctctctcctagaagacagttgaggagttacaggtggatgggcatcaagaacacatagtacctttcttcggcagcagcagaggtctgggagtgcttgtggagaacaaaaaggtggagctcatgttctcagtaatttgggaatttgagagagggggctgtagccagggtggagggagaaccaggggagacttaggaagagaaatcagtagttccacaaggctggagagtcaaagcgtcaccaggaagggcctaggtttggacctggaccaaaggacctagaacctcttaggacttgtgtccttgaatggacaggtttggactcttggactatactgtgcatttcagaattgctgtttgcatccagataatcatcacgtttgtagccaagtgttttttgcctcatttgttaatgtaataatattaatataacaaacattcatgaacccaccacccaaatcatgatctagaacattgctaaaaacttacccttactaatatgcttaatattttttggtagtcattttgataaatgattgtctgtcttctcagtatggtggttgtggtttcctatctctaataatgccaaactccaaaggaaagatgtagcttgtgttattggtcaggatgaacaactttgtgccgtgctaaaagacatccccagaatcctagtgggtcatgacaacaaaggtttattctttgcctttgctttatgtctatgatgagttagctgagggctgtgctccttgtctctttaccttacagctccggtgatcagagaacctaccgttgtgaacattgctagtcattatgggaaagggaaagagagccctgtcaggcagcataatggcatagaaatattccagcttggaagtcacatatatttacttctgtgccgttggccagaactcatcatatggttccacccaactgtaatgggccaagaagtgaaatctcaccacgtccctacaaggcacagtgctgggaatatttgggaaacagtgctaatgactatcatagcccacttgcccactgtggtacaacatatgaacatgacttgctcctagctgatgaagttgtggagaaggaagggattgcatgagcagggttgaggaagcccacctgagttttgtccatccctgtgtccctttaggtgataccgttaaggcagcctgccccattatgcaccgattttccagccagagcccccttccccttggaagttcgccattctgctctacctgtttctgtctgtctgtatttcacaggcttcaaggacacagggcatttgaccatagagtctgactagcagctcacttgagatctccttggcgtcttcttctcccatgcatgattgctcagatatccaaggagctgctgctacctcatccagaatggcacttgacttgacagtggtgggattggattttgtgcagagtggtgaagggaggcgagtagggttgggtgagtcatcattgttatttccgttgcattcccatcgatctcacaaagctattaaaagagtcagtaactaagacatagctcgactctggttctaaaagtcaagtgataattgaaattcacattgcaaatcctgcccaggaaatggagtgaagagaatgcactggctcttggccccactgctgggaaggaaggtatgagctgatagctcaggaaacatatccttagcttgagagcacaggacctgttccaggcagctggccccaggatgattcctctgaccactgagtgtatggcttggagaaggcaagtgaacagagagggctttgatatggtttataccgtaaggtgcggagatgagcaaaacagacaatgtccctggtctcacagaaattagagtctagtgggggaagaaaatgattaaacaaatattatagggcatggcaagtgctctgacaaggctgagtacagggtaataaggcaatggcagctaagctggacttggggagccaaggccagcctcctagaggaatagtccttcatctaaacagaggactgaaggataattaggtggtagccaggtgaaggcaggtgggaaggaaggaagttgcagaaagttaggaggtagaggggagtgggagaatcggagcctagagaggcaggcagggactagatcatgaaggaccatgtaagccatgttaaggggcttggacattatcctgaggggagcaggggaccatggaatagttggccattcagatcacacttgcttttcagaaacatcactgtggaagcagtatagaaggtgggttaggaagttgtgacattggaggctgggagtgcaggtgacctgcttaagatatttgtgatggagatgggaaggaatggatgaatctcaggcacatttagaagaaagaatagacagatgtggacagtgaaggaaagtcaggcatcagggatgatgcctaggtttctggcctagacaactggagagcagtgatgggagaataggttggtggttaagcgtagtggctctgaagccaacctgtctggattttgaattccagatctgccactgattggctgtgtgaccttggacaagttccttaacctctctgtgtctcagtttccttacctaaaacgagaatattaacactaccttccttttaatgattaagtgaaataatatatataaaatgctttgaactgtatctggagcatagaaaatgttcgataaatgttagctattataggcaacaaggaagaggaacaggcttcataggaatgatgatgagttcagttctgagcatgtcaaatttaggttgtctgtgggacactcaagtgcaaattggttatatggatctgaggctcaggagatatttggctagaaatataaatttgagagttatcagtttatagatggtaattgagaccttggaagactgtgcagggagaatttgtagagtgggaagaaaagaaggcctaggagcaagacctgagaaccctcaacatttgtggacagaggtaaaagagcctaacgaggaagctgagcagcaaccagagaggagggagaaaaatcaggagagaacacagcatcatagaagccaagctacaagaaagtttcaagatagaggcagtggccaatggttgcagtgctttggagaggtcagtataaaagaagatctgataaacaacaatgggagttagctacgagaaattgttggtgagactagtttcgtggagtggtagaactgtatgtcagactacattgggttgaagagtgggagtgaggaaatggagacagcaagtgtaaacaactctttccagaagtttgtctgtgaaaaggaagggtgagcagatgattgcaggttatgggagaagagagggcatgcttcagtgctgatggagaagaggctgacagtagagagggaaagatgggagacacaggtgagggaggggacaattgaggcttgaagtccctgagatggtgggaggagatggaactcgcagagtgcaggccaggttggaagtgttaatcttggttgggaggagtcataagagggaaggcagaaagtatggatgtggtgagtgaatgtgcagatttggttgtgggaagttgctgcctggtggctttctctctgtgaaattgggtgagggggatgtggcaaggctgggggtttgtagatgatagaagtgctcagagagccactggataaaatggaagagagagcccaatggagacggaaaataaaaagggttgcctagttgtaccagaggcccagtaggttcatagcggttcccagctgcatggttggagtattttcaccaaggagtgcttagcaatcctggagtaggagcagaaagggtagacatttggattgatttaaacatcacttgtggatttgcaagatggatgaaggatgggcaatggagtaagaaaggtgcggatgtcggtaagggagtagttaaaatgattgactcataattctcctactctctgattcagaagcttctgtttctgctgctgcttacaacttctctctattccccactccatagcttctgctcattcaaggctcttatgctcatggcttctgcctcttgtgtatgtgtgtgtgtctgtgtgtctgcttttgccttcattactgactgaagaccctctccctgtctcacattcagaatccacaggaaagactatctgagtgattctatgggtcattgtattcatgtttgactgataggtcaggtcaccccttaggctgctggccaacctatgggttttctgccctgagtcagggatctatgtctggtccagtcagcgtcaacatctttcagaaggttttgtgagtaaaacaagcagaatggttaaggggctctggaacctgatgcctaggcttgaatccaggctgtcccacttattgtgtaaccttgggagatttacttcacctctctgatccccagtttcctcatttctaaaatgggttcagtaagtgtacctgcctcattaaggtatttgtgaaaatgaaataagacagtactaaaaagcacttagcacagtacctggcacatatttatttccctgtaaacattacttattattacaatcattgctattatgattattttactatgaaagcaggcactgggggcctaatagaatttagaaaagacattaggggagatgggatctgaactccatcaccattgaataaacacagtcttctttccttcacaccagctctttaccattttctggtcttctgacctttcctcagggaatgtttgtcaccttgtgggctctaaaggcccaaagcctttggagtactgagtctgccatgagctggggatcgagctgctgggtctgctcattgtcagcttgggaggaatcctggcagcgaggcctctgttgctcagtcctcggtttctatgagtcatgctcctcttatgctaagtccagctcagatttggaagggggctagaggagtgggggtggatgagggaaggaaagggaagaggaaggcagcagtttagcctctttctgagtttcttggttagctccagttatgggaatctttccttagagctctagtgagaggatttgaggccccactgtgaccagactgcaatgtgaggggatccttcacctgcatggtgcagcctaagatgcctgatgtgtgaccaacccctccccaggcaccctgatagtcagggcatcttctctccatctctcttttccttacagcttgatacagatgggtaaagattctttttcccctgaagataatgtaacttgctgatgtaggggaagggaatgtattaagaggcccattgctcagatatcaggctccttgaaatgacctggtccctgatgacttgtgtctgagctgatgttttcctaagggtggtgtttaggtcactagtgaaacatgaaataatttcaggtagtacctggctgaacattttttaactttgatagttatgcatttattttcatgtattttagaagaaaatataactaacatacaaaactggtggtttcaagggtattattgtttaaagccatgtaaagttttagaaaaggaagtttatttaaagaaaaatactaagtgaatagtagtgtaggtgttagacatgtagcaaaagtcatgaaggtagtacacagatgactgaggtttgggaaagagtggtcttaaccaaatgacgttcccttttctgctgcctcttttgccccccacccccagactcaggatgtctgcgttgggaattgtctaatagacatagtaatctgtgtggtcaactgtcatctgaacaggtcaaagtcaaaagccccatctccctttcttgacttcctagtctttgtcgagggctctaatgctctctctctctctctctctctctctgtgtgtgtgtgtgtgtgtgtgtgtgtgtgtgtgtctttcccagcctggtgattggtaatatccctgggatccctccctcttccattttcacactgaatcttgaacaagtcctgttaattcttccttcagagtctctctctccctctccctctcttttttttagagagaggatctcactatgttgcccaggctggattcaaacttctggcctcaagtgatcctcttgcctcaacctctcgagtagctgggactacaggcgcacgccaccatgcccatctcagaatatctcttgcactgtgctccttccaactgtcatcacccgtttgaataccacagcctcagtctatacttcaccatccaattcatcttccttaagcacaactttcaccatgaatttctcctggattggttttccactgagtatcagatcatggccagactcctgaatgagcaattttcagtccttggactatggcttcagcctaacagtatctgcacatatcgcctgtttcccttctaggacccatctaggtctttactattccacagatgtactctgcttacctctagctctagctctgttctatataccttgactaaaatagtttcttcagtcctttccatttggttacttacttattttccgtatattgctttttgtgtttcatttgtgtctctttaagtagactcagcttgctgaggtataggagtgtacttttcatttcttttgtaacctctttggcatttagcaacatgcaaggcatatgggaggtataactgggtatactttggcctgaaagtaacagaaaacccaacttagagtggcttaaacaaatagaggtttattttttgcataacaaaaagtttagagttaggtggttgcctgctctgccatccgtagtgaattggctttcatcctacgcttgttgcctcatggtcacaggtggctgttgcatcttaaggtatcacaactgcattcaagcaggaagaaggagcaaaggttttctgctcagggggctttgtcctgttatttgggaagggagacttccccaggagactgccccttacatttcattatccagaaccctctctccacactcttgagtatagcctgctagagaaaagacccaagttcaagttacaagagtgtggactgagagacttggccaatgcctgcccacctcactctgcttctgtcacatgctccctcttagaccagtgactgatttagaccaatcataattcaagcctgggactgcagttgagttttccctctctgatatgaaagaatctttgccagctacaaattggagttctgttagcaaggaagaaggtgcagaggatggctgtgaggtaggcaaccagcaatgtctaccaaagagctcaataaagaccagtttagagagtaagtggcctgctccggtcctgagtcaggttctaagatttggtaggtctaaggccaggaggtttccagaaagagccatcttctctgtgcccaaacaactgcacctgaatttccctgactgtccattggaaggtcaagctggtcatatgggctttctcggctgtttccctcagccaaaaggaagagcctgtgtagagcatggtgctgtcccatttagttactgctaggtgagtagcttctgcctgtggctctacttcaaggactgaggggagaatgaatggataggcttgcttcttcatggaaaaatcatccctgcccttggagctttggttttcatatgttttctggagtagttctggaattgaatttgcacccaaagaaaaaaatctagaagaggaaatttccaaaatcacattgtgcaaagtgttatttattatagcaagaaatagaaacaacccaaacagccaataatagggatttggctaagcagactgtgagttttagtatattaggctacaatacagccaccaaatgtgactacttcaggaactctgatggtacaaaaatatatatggaataatgttaagtggaaaaggcagaaaaaaatagtaggtacatactggctgtgtaaaatgtacatgtgtgctttgaaaaagatcagaagacagttgtccagtttgaaatcaaagaggaattaggcaaccaagatgtattttttgaaattgaatgccaactctgaggcagttgggggggtcatccgttggggagtccagttcagctgaagtttaaaaagtgggagttagggcatccaatactattccttctttcaccatgaagacggaaaggttaagatagagcttgaacttgaacttgggtcttttctctagcaggctacgttccaaatgtggaaagagagacttggcctctgtgggcccacctcactctgcctcactgctgagaagtcccctttcttctgtctcgcagctgacgaagcattctgttggaagactacacttccattccagaacagtgtgcgttactgtgtggagacccagtgtgagttccttcctgaggtttcttggcactggctgtgctcctgcgtccccccaccccgcaacccctgccgttcatcatccaaggtttacactgtaaatatctgaatggggtgaaaagaaaaaccagacctccgacttggggctggtctgctggaggctgagccaagggtgtgttgttgatatagaagatagttctctcctaagagtttactgaaggagattatttttgctggttcaggttttccaactttattcaagagcctgaagacaggagggaagcaggatgggtgtgtatatgggctagcagggaagagagacttgtttttctcttttttcctgaccagttgctgcccagcaatagctgccatttattgagcgcttactgtgtgctgtgtgctttacacatgccatcttgtttaaccctcacaagagctttgccaagtattacccccacacacactttacctttggggaaacaggctcagaggggacttagccagagtaacttacccagggaataatgaaatcaggatttgctcaacaaaaatgtattgagccacctactccaagacaagcctcaggctgacataccggctgtgcggctgtgaataagatcggctcattgtcttcagcaacttgtacccataagggtgggtgtgacagataagcaggcagtgataggacagggtagtgcctgttctgatggggaagagcctagtgccatgggaggacagagaagggggaacccatcacagacaggagcaggaggcagggagtcagcaaaggctttccagagaaagtgatgagctgtatggatctggagaaagagtacaagtcagcccagtgaaggagatggccaataagcaattcaggcagagggcatagcctgcctgttgattaagtattcaagaattttgcaagctggttatcagaccattggtcacttcaaattgggtcatgatggaagtgtttatagcaaggaagggagttgggagttctcagctatagatgtgaatgggattaccgtggcaggctatacagagtgccaggccgaggaccaagccttggtaaatgctaagaggcaggcagagaaagatgagctcacacaggagactgacagggagcggtcgtctggctccactttcacaaccatctcatcatttccaactctgttaccactgcctttcttgaagcccatatcatcttatatctggactatctagtcagatagtctttacaacttatctcctggtttctcaagtctttttaaaagttccttatagcttttctgctaactgggtaactgggtaagtaaaataatctggttggagcagacagcttatatagaagagtatggattttagcatgttcactcctaccacttgctggctatgtgaacttgggcaagtttcctggtttttctgaacctcaatttcttcatctgtaaaatgggactagtacttccttctgctgccagggctctgagaatccatggagactacacatgtgataaagggcccagcacagggcctggttcaccattggccagtggagaggtcgccaaagattttcccatatggtagctggtatccacaggaaggctcattgaggactctgcaaacctccatcctcagctgcgcaccctctacctgggcactccagcttctctcacttcccttgtctgctgctcctgcccctctcctcccttccattctggcaaaattgaacaatggccccttcctctaccctccctgcctcatgctcaacctgttcacactccaggagcctgaagaattcctgttcctcaccagcccatcagggcttccctctcctcactccagctgatccttgactcttggctcctcctagaaacgtccttgggccatgggcctccgttcctaacctcgtcctgcagatgtactaactttagttcccggaaccggattgaaaggactagaatgaaccgcatcaaatgttaaggaacacaattcaagaacgctgcagcacttttcatgtgctatacaacagattgtgctgaggctggggggcatagatgcttgttggcagcagggttgttttccaaatcactccctgatgctttgaagaggaaaaggaagtaagttaggagactagtattcattgaatgcctcctgggtgtctggccttatgctagggtgcttcataaattgtgtcattcattgtcacaacaaccttgtgagatgatgatgttattcaagttgtctgtagtgtccctgcttccctgtgagctctgtgaggatatggaacacactgtcttcgacactgcatctggcaacctggatggagttggagaccattattctaagtgaagtaactcaggaatggaaagccaaacgtcgtatattctcactcataagtggaagctaagctatgaggatgcaaaggcatagaatgacacaatggactttggggattcggaggaaagggtgggaggtgggtgagggataaaagactacatactggatgcagtgtacactgctctggtgatgggtgcaccaaaatctcagaaatcaccacaaaagaacttattcatataaccaaacaccacctgttccccaaaaacctatggaaataaaaaaagaaagaaaatggccattaaataaaataaaaagcaaaagagatccaagagagaaaaataaaaataaaataaaataaaataacaggtgtcaacacacctaaaaagaagaagaacatggagtctgtgctcaataaataccggttgaattgaattgctgacactgttgtgttgaggcagtttggcccaggcaggcaaataagcccaggatttgcagtcttggcctgtgtggctttgggcaagctatttcatttttctgagcctcagtttcttcatgtgtaaaatgggaataatgacacctatatcccaggggttgtgagcatgtgcaagtggtttggtaaactccaagtgctgcccaaattagtgtgtggggtgcatcacatgcgctctaagctaggcttttagttatccaattatcatctaggtctgcagttcccaaatgcaaatcagcactcatccttcgtaaagtttttactcttctgaattaaaaaatgatgatgtaggccaggcacggtggctcacgcctgtaatcccagcactttgggaggccgaggtgggtggatcacgaggtcagaagttcgagaccagcctgaccaatatggtgaaaccccgtctgtactaaaactacaaaaattagtcgggcatggaggcacgcacctgtagtcccagctactcgggaggctgaggcagaagaatcgcttgaacctgggaggtggaggttgcagtgagccgagatcatgccactgcactccagcctgggcgacacagcaagactctgtcaaaaaaaaaaaaaatgtagttttgtttttttttttttgagacaagttctctgtcacacaggctgaagtgcagtggcatgatcatggccactaatttttgtactttttttttgtagagatggggtttcgccatgttgcccaggctggtctcaaattcctgagctcaagtagtcctcccacctcggcctctcaaagtgctgggattacaagcatgagccaccgtgcccggccgatgtagtttttatgaagccaaatttgttcagttttttaaattctaaaattgtcattccaattgtttgatgttaaaacatcattttgttgtttatgacatcttggttttagtatatggcagtttttaaaattaaaaaatgctcttacttgatcaaataaaatgttggcacagctatgccagatcccccaacaagaaaagtagcatagaggggctgatagagaggaacctgggctgggcgtgggtgagaaggcatttgaggtgggcttcctgaaggcaagggggcctgaggagagttaagaagggtgaataggagaacattcagcaacaaagggtgggaaagacacaagctggagagctgggccaggatgagtccagacaacctctagaaatctgtgaagtctgggccgccacccagcaggtgagcacctctgagcttccctgtggagtgttagggtcggggagtgagccgatttgtcccagacccgcctggctcacacacggggatgaaaaagtccaggtcactgcattggacagccactgagctcccccaccacagcccaaaggggtgccttgcggtccgtccaggcaattgctgccacactctgcatcaaacccccaactccccgtctgactttgcctatcctccacctcctctcctactctggcagcttcagtaaagcaggaatcactcagctctgtgtgtgggaaagcacagagcccacagcgcaaacatacaggctcatcggaaactcgaaatcccccctctgccttccacataccaagccacacacaaggagtggcagtggggtagaggctggttcctttctccagaatgccacagggctggcctgaggttgtggtgggggaagcacttccccctggccagctgtatgacctctggattccccagaccacacggttggcagcaggaggcccctggcggctgggagcgccagacccatccgctggggcagagagtatgaccacctgagcatgcgctttcgcattccaagtggtgggtctggattatccatttcttggttttctccagacctctgctccatccatcagagtatttttttttccacctggaatcctttggccagtgggtgcagccataagtttgtccagccaggggcatacgccaggtgcctgccgagctgtccatctggcccaggcaagaggcaaaggataacttccagaaaaagagaaagcccatgagggcagggcagaaggcaaggctaaggagtggaagtaacagtcccaatgcccagcccaaagacctaagcctggccaacaatactcggcaggcatccctcgctccctgtttagggcaggttgccatggtattttgcctgctggtgcactgggactggaaaaaaagcagagtgagcctgagggtggaggattgggaggatggttaataatgggaggagagctggactttttgccccagttctagctggagtttgcttcagcagcagagtattgtggctgtttcagggagaagcccttgtgcctttatgaccccagggattcctgctgctataagtgcccaagaatggcatatgccttacaagctgcccaagggccgggcatctatgccatggctctgctcccacttgtgacatggtgggtctttcttatggcttgtaaactctccccatccctgtggctggacttagacagctctgtttatcattctcacactgaaccaactagccatttctgtgggtgggtgtcagtcacaccctactgatttctggtatatcctgacattgagtagcagcctgtagctgtgatggggagaaaggttaatgctcattttgacagaagcattagagttaagtccaaactcccgggcttggcattcaaagacttcaacaattaatcttctataatgctcaacattccaatgccacatatttggaccccaaaatacaaaatacacacacacacacacacacacacacacacacacaaatacctggcatcatgttgaaaaaaaatagtggatagaaccttttcagttttcatttgtgtgtttgccatctcacagttacaggtatggtgtcaaattttatttgcaaattgacaatctccaactctgtgtgtctaaatatatttggattatcagtacttgatatagtgattggtgtctctgtgtttatgtgtccaagtcttacctgcactgacaggccaggcaaactaatttgttctccctaagattttagacataaagctaacataaagctttgctataagaaataggttgaggagaatcagccaagtccctgctttcaattcttctggatatatatccagaggtagaattgctggattatatggtaatcctgtgtttaattttttcaggaactgccatactgttttccctactggctgcaccattttgcattcccatcaacaatgcataagggcccaatttctctgcatcctaaccaacatttgttatttcttgtgtttctggtaatgtccagcctattgggtgcaaggtggtatcttgtggttttgctttgcatttccctaatgactagtgatgttgagcctcttttcatgtggcaggcatgtaagtttttgacctgttgatgaaactgcgcatttagtcttgttttccaaacactcttggacactggatatggccattgttttataggttagaatgacctttacttaaagaatgctttgttgtgcagttacctctggactctccacatgctttgaaggctgcaaccttacagccagtcagccctgtggcttctctatactctctgcccctcactgtagacttggctttccataagccctaagatttcttcgattctctgttttctgttgtatttaacccttatagtcccaccctgctgtgatagccagccagccatcctgaagaggaaaagattcagggaatggagaagaggggaaaaggaaggaggtgacagatttctctgaacccattatctggtcaaaagagtaagtgaatctggtcctccttctatgcaaaaacaaaaccaaaaacaccctattttgtctgtctatcaagcagttctatgccttcttagaaacttgcctattctccaatatgggttgaagtatagaaaatgtagctatgagagggcaagtgtcaaaatgcctggatttgtcactaaaaatgctatctagggatttcctttactgattgatctcttagtgagtgtaaagagccagtgaacctcatggaaaacaaaagtaagaacaaaaaggaagcccctccaagttcttagcattacagtaggagtgtttacagttggagaagggatgctgtcttagtcagcttgggcagctataacaaaatgccatagactaggtaatttataatgaatagaaacttatttttcacagatctggaggctggaaagtccaagataaggcgccagcaaatttggtgtctgatgagtacctgttcctcatagatagcaccttctacgtgtcctcatgtgggagaaggggtaaacaggctcccttccctcaagcttcttctataagggtactaatcccattcatgagagctgagccctcatgacctaatcatctcctaaaggcctcacctcttaatactatcacattgggtattgggttccaacatacgaattttggggggctaccaatgttcagagcatagcagacacgtgtcttcagtttcaccttcctgttggggtcctctccctgatccccactgtccacactataccaggtggcctgggttaacccacctggggaccagatccacattcttctcctttggactcctgagatatcttgcattctcatcaggaaatttgtcaaatactacaggacagcaaggaggaaatcattgcaaaaattacaatgaacagcatattaaataggcaggtttcctgagtgtaagttttgggtccaacagtgaatgcagtctgaaccaccaagagccagggcatcgtggctggtcccttgcctgacgtccttctggcccagctcccagcctgtctctggggagtgggtgccatctaactctccactgtctaggagaagtttccaggataagaccagaagagaccatattccaaattagctgttcatttgggccctctggctctaaacctggatccctgtttgggaagtagctgtgcctccctgtatacatcctcaaggcaaatggtcttgttttctagagctggcttcccaaggtagacctgtgtcccccagagagtgggagtccatctcgtgcttttggatgggacacgaattagtattatgtttttaatagcaatgtgtttactttcgtagtttccttctatttaagtcatgtggtagtggttttccatttacatcaatgagtcacagattttttaagtaaaagagtaagaaattgaaaaaaaattaactaaataatagttaagggggtatgtggatgtgacaaaaattgtgaaggtagcccccaagtgactgaagattgggacatacttccttagagtgacttgcctctctaaaaataaccttttaagagacagttgccaggaggactgtgtgaaagaattaccaactttgggttccagggatctttccctttctggatctctgatgctctctggtgagagcaaggaaagcctagaatataattttctctcccctttgaatagttctactaataggctcctctgtgagcacagataaaggggccattgaccatattttatttcttcattagcttcctgtaatgctttccttgctgaaattcaaggcagaaatggtgtgcctaaacctcagattactcttcttcagaagaatctcttcagctcaatagtttaccttctatccccagcctgcaccttcgagaaagaggatttttcaaatcttttctcgttttgctcctcactctcccagcacatattttccagaagcattacatgggaagcattcataaacattttttgcactgaagaaatctgcactaagcttgacttctgcttataaaactactccttgctccattatgttacaggcattccctggggggctgtccctggcatgctaggaagggactgaggcatctggcgtttatctagtccctgagccaggcactacatgagccaggagctacactaggccttctatttgtttgaattctggctgaattctcaaaccagcccagtaggtgtcatttgacatctgaggaaactgagctcagagaagctcagtaacttgcccaccatcacacagcaaggaaggggcagaagccaggaggacttgcccccggtttcctgactctcatgcactgtgcactgcctctgtgggggcttgctcttttctgcctggcgtgtgctgctgcgctgctgtttggacaactagcaaaaggtctcaacacaggggctttctcttttgcctgcaacaacaatgagctcaaggggaaaacagattgattaaagctgattttgccctagtgagaaactggccagagcatctctggagggcctcgggctgggcccagttggctgtcaggatgtggcctggagcctcacttcccttcctggctctccctttatcttctacactctcccattgccttctgcgccctgaccctgctgcccttccatgggagctgaaaagcaagctgctcagaaggaaatggcttttgttatttaacctgaataagtgtcaccatgtgccttctctggaaatctactcatggctgaagagggggaccagggttaccctagtgtcctttgttttgttaggggcctaaagcagaagcaaaggcaaccctcatgtataccactgcttttgtccccacttcctttccaaacactgatcttaaccctattcccctaaaacatagctgataaatgataaatattcaggcccttgcctggcattgcaagctacaaacaagctggtctcaagcagcctttccagtcttgtgacccaccacttccttatacaatcctcactttcctggtggccagaatacccaccatgccctaaacgctcctggctttctggcctccttgttcctcccacctctgcctattaagcaacttcgtgaagtaggaacgagctcacatccgaagcgccggagagagtggcatgcctaccagcctcatcttctatgtgcttcagtttccttctctctcgaatgtgcctgatggtgtagcccacttaccttgtcaaatggttgtgatgagattgaatgctatgaaaaacccttagtaaaatgtgaaacaccatccaaatgctgttttgtattggtaaaggaaaatgacccatcctttagggctcagctcaatggcacctcccccgtgaagtctcccctgattccctggagagagtgatcactctctctttgtgcagtgctgtagcacttggtggttcttggtggtatgcatcactttttgcccagcacgagagttatttgtgtccaagtttgcctattctgtcttcaaggccgggagtttatgtggagggcagagaagtgcttaggcatctttgtttcccactaggcctagcccacacgtctcaaaaagcacttattgaactggggaggcaaaaaacaaagtcaattctttgacctggaagctcatctgagtccatgtatgtctcctctgggagctgtgagaggagggaaaatgacagaggatggggtggggagggtaggatggctgtagagggaagtgatgggaagctttcgaatgacttaaattgacttttttttttttttagttttcattcaattctgaccacatgtttcccatgaatccttagggagaaggaagtcagaaagttagtccttcgcctctccctggctcgccctggagtaccacatggatgagccaaagagcaggacagcctgaggaacttgcctcgtgggcctcacgctctgtagcaactcagaggcagagagaagctcctgggaggccccatatgtgacagcttctaaggaagctgcttgtggtgcatccatgaaacagggtggaacaactgctgattttgaacaacaaagctacttggaggccacattagactcagaccctgctcaacatttgggttctccccaccccgctcttcttttacattattgaggtaaaattggcattcactaaatggcacatatttgaagtatacaggttgatgagtttgatcatatgtatgcacctgtgaaaccattactacaatcaagataatgaatatttccatcacccctaaaagtttccccttattgatcacctttaatctttcttcatagcctaagtaagggaagaacatggttttattgttgatgggttattcttatgttagaaaactatcaggagcagtggccttggggacctgagtccaacttaaccctctgtgagcctcagtttgtccatcaataaaatgggatagttggacaaaaaaattgctaaggtttcctgtcagtctgagtgacaggacctttctatgatacaacctttctaaacagcaatttttaaaaaacataaaagaagtgtaatctactttgctttctcatgcccccaagttacattctggcagggtcatggctgatggtcagagtgatgtcgggttctgagggttctgggtggattattaactacattttacagatgagaaaacaggctaagaaagaagagaagatcggctcaaagttacacagccaacacgtaactgagctgggatgcaaatccagcagtgactcctaatctaatgttctttgcactgccccacactccattcccaagaatacaggcctagttccatgttgctgtcatgactaagggtccttgcatccaacagatagttctactttcctcctggtttaatctggggaccatagttcacctcctcagatctctggtaggtaaggaggcaagagaggaggctcccctgccctcctaaatcagaccaaatcaggccacagaacaggagtcttaagttttcttagactggaggtttccagaaagcagacgctctctgggcatgtaattcattgtattcagcctcctagtaccaggtacggacaaatgttcagtaaaccccatggcgggaacacaaggtcagcaggacaggatagaaatcttgggattaggagggacctctacctggcactttgcctcatgtttgccctggggtacaatcccccaaggggacctgttatgggctggggttggggcagtgctgggctgagctgagttgcacacagtcattatggtgtgagcacgtgccccaacagtgcagtggcacgatctcggctcactgcgagctccgcctcccgggttcacgccattctcctgcctcagcctcctgagtagctgggactacaggtgcccaccaccgtgctcagctaattttttgtatttttagtagagatggggtttcaccgtgttagccaggatggtctcgatctcctgacctcgtgatccgcctgacttggcctcccaaagtgctgggattacaggtgtgagccacaacagctgcatcttttataactccctggaggaagggaggggggccagttactttccctgccctttttttcagacccccagtcggcctactgtgcctcagcgtaaggtaggaaagagtgcctccatggggaatttgtggtggtagcagggttctgagcagacccagggtgtttactccctgagtactcaggaagtacccagagtaggtgctcagtaaatatctgctgactgactgaatgaactctaactccatgtcaagcactgtagggggtacaacgatgaattggcctccatccctgactgtagcagagaaagagggataagacaagcacataaataactgttacacacgacagaatgtgataaatgccttgggagatgaacagccaattgctcaaagagcttggaggagggacgctcacatctggcaatggtggggggaagggactctagagaaaacttcctgcttgaggtgacattcgagctggttttgaatagggacggggtttctacagtggctcaggaatgtttgtgtggtgggggtggggagtcaaggcaggctgcattccaggccccagcagcagacttagggccagaagtctcccttagtatatcctcagagagcacagagaactgcaaatcagtgatagtcctagagcctcactataactgcgtgttttcaacctccatcccaccatgccttgatttgagaccccctacaagtggccaaatggacttagctgggctgcttgctggctcatgggctagctagcccaaaccagaagtgagagccagtcctggtggccttgcagacatttcctcatgaaagcctttcttcccagctcagctcttatctgggaacaataaaggtcctcaactctgggagaaggccatgcagggaacaatagtttctggctcacttcatccatcattcatgtggctcagatagaccattgctgagcagcagtggggacgagttgggggagggggagggcacattattttgcatgagattgttcattgggctgccccaaaactacacagtggggaattgggtagcgacattcctgggtgtgctatacataggcatgagcctgggcatataatccagccctttctcttctctctgcctctttgtttcctaatttctgtccagaggcagttggttgctgttaactggtaaactgaatggtttcactggacatgggacaagatattggattcatttcagcagatattttcaaatatattatctcattgaatcttcaaaacaattttataagttggaattattattttcactttacagatgaggaaactgagggccagagaagttaagcaactgccaaggatgcagataggaaggtgaaattggatatcaggactcctaactgcaagtgacctcagctgtacagtctgaaggctggcagttacaaattagttgcaaacgatccagggactgaacaaaggagaaaaaaggggaaatgcgagagttaggcagctaccagttaggcaacctattctccttgtgccaccatgaagaataagttgatcaagggtggaaaagaaaactcagggcttcaattccagtatggaggggtctagaagtctccagaggataggaaagaggatggagatggagcccccactcatctggctcttgcctgcccagggtgctacagcgatgcagccacagcctgtcggctctgttcacctctttaaggttgatgtcagccaaaggcagcccccagagagggaccacttatcctgaacaaatttatcgtatgaatatttgttaatgtatacaacagtaagagtcttactagtatatttctgaaacagatttataccaaaaattagtctggttttaattaaagtattttaacagctttttaaaaaagatgtaatttaaataccacaaagttcacccatttaaagtgtacaatttaatggtttttattatatttaaagaattgtgcaatcatcactacaatcaattttaaagattttcagcttcaaacccccaaatcaatattgtaccctcaagctgtgaccccccaatccctcagcctctcttactcctccactccccagtactaggaaacgtctaatctactttttgtctctagagatttacctactctggacatttcatataaacgatattatatgtcttctttttaaaatagcttcttttacttaacatacggttttttgagatttatccatgttgtaagatgtatcaatatatcattctcttttttttgtggaaagatattcaattatatggatataccatgttttgtttacccattcatcagttgatagacctttacattgacaagtatttttgcggagcctaggagtggaatttctgggtcatatgctaactctatgtttaaccttttgaggaactgccagactgttttccaaagtggctataccatctctccacatcctcatcaatacttgttctgcaatgttgtcttgcttataaccatcccagtgagtgtgaagtggtatctcattatacttttaatttgcatttccttaatgactcatgatgttaaacatcttttgatgtgttagttggcactttgtatattttctttggagaaatatcttttcaaatcctttgcccatttgtaattgggtgatttgtctttttattgttgagttataattattcttgatatattctggatactaggcccttatcagatatctgatttacaaatattttctcccattctgagttgtcctttcactctcttgatattatctactaatgctcaaaagtttttaatttttatgaagtcaaatttatagctactatgtatttcttttgttgcttatgctttttacttcttttgttgcttatgcttttggtattatatctaagaaagcattgccaaatccaagatcatgatgattgactcctatattttcttctaagaaatttattggtttagttcttacgttttggtctttgatccatttctcttttattagggtaggaatccaactttatccttttgcatgtggctatccagttgtcccagcaccatttgttgaagagactgttcttttcccattgaatggtgttgacactcttgtagaaaatcaattttctgtagatgcatgggtttatttcttcactgtccaatttattccatttgtttatgtctttctttatgccagtaccatatggttttgattactgtagctttgtagtataactagaaatctggaagtgtgtgtcttccaactgtgctcttcttttctaagagtaatttgtctatttggggtctgttggaagaccatgtgaattttagaattggctcttccatttatgcaaaaagggatattgggattttaatgggaattgcattaaatttgtagattgttttcggtagtattgacatcttaacaatactaagtcttccagtccatgaacttagactgtatttctgtttatttatttaggcttctttaatttatttcagcattgttttgtaattttcagtgtatgaatcttgtacctccttggttaaacttattcataagtattttattctttttgatgctattgtaagtggaattgttttcttaatgtcatttttgattgtttattgataatgtatagaagtacaactgattttaacatattgatcttgtaccctgcaactttgctgaattcatttattagctcaatagtttttctaggattttgtatatataagatcatgtcatatgtgaatagagatagttttactatttcttccttaactatgtgaatgaatttttccttccttctgttcttctttcctttcttctgtactttcttcctccctccctccctccctctctccctcccttcctcccttccttcctcccgccctcccttcctttctttattccttgtttttcatttattttatttttgcctgaatgctctgtctagacgttccaatacagtattgaatagaagtgtcaagagagggcatccttgttttgttcctgatttaaggaggaaagctttcagtcttttaccattgaatacgatgttagctttgggtaggtttttattttatgcctcttaccgtgttttttgtttgatttttgtttttgagacagaggctcactatgttgcccaggctggagtgcggtgccacgatgatctcagctcactacaacctccgcctcctgagttcaagcgattctcatgcctctgcctcccgagtagctgagattacaggcatgcaccaccatgtccagctaatttttgtatttttagtagagacaagattttgccatggtggccaggctggtctcgaactcctggccttaagtgatctgcctgcctcagccttccaaaatgctgggattacaggcatgagccagtgtgcccggccatttatcctgttttgaaaattcccttgttttcctcatttgctgagtgttttattatgaaaggtgtgaattttgttttttgtttgttttgcttcattttcaaatgatcatgtggtctttttcctttattttattaatatgacatatttcagtgattgattttcatatgttaaaccacccttactttcctgggataaatcctaattggccatggcatatattcttttaatatgctgctattgaattcagcctgctaattttttcttgagaatttttacatttatataagggatattgatctgtagttccttttcttgtgatatctttggctttgatatcagggcaatgctgccctcagagaataagttaggaagtgttccctcctcttcaatattctgaagagtttcagaagaattggtatcaattattccttagatattttgtagaattcaccagtgtagccatctgatcttggacttttctttattgggagatttttttattactgattcaatgtctttatttgttataggtctattcagattttctatatcttgagttcattttggtagtgtttttgtttctaggaacttggttctcttataatttttttaaaatttctgtaaggttggtagcaatgtccccactttcatctctttccttttttttttttttttttttgagaccagatctcactctgtcacccaagctagagtgcagtgacaccatgatagctcactgcacactcgatctcttgggcttagacagtcttgttgcctcagtcttctgagtagctgggactacaggcatgtgccactatgcctggctaattttttttttatttaattttttgtagagaccaggtcttgctatgttgctgaggctggtctctaactcctggcctcaagtgatcctcctgcctcagcctctcaaagcattgggattacaagcatgagccaccatgcccatcccctacttgcatttctgattttagtaacttgtgtcttctctttttttttccttggtcagtctagctagagatttgtcaattttgttaatcttgtcaaataaccaactgtcaagtcattgatttcctccatttttttctattctctacttcatttacctctactctttgttacttccttccttctgctagttttgagtttagtttcctcttatttttctggcgtcttgaggtgtaaagttgatcttctccctggttctgtccattattgaaagtggtaaattaatctgtttatggtaagccctagagcaacagttaatatgtaaataatatagtaaaatatttatttttattattcaaaataattttaaaaatcaaagtgctatgatagaaaacattcacttaatgcaaggaaagcataaaggaggaatagagaataaaaagctatgagacatataaaaacaaaaaataaaatggcaaatgtaaactcaattatatcaatagtaatcatgatattaaatataaatgaattaaacaatccaatcaagaggtagagattgtcacacaggatccaaaaaacagtgtaacagtataactacatgctgtctctaggagacactctttaaattcaaagatacaaatagattgaaagtaaaaggatggaaaaagatatgtcatgcaaacagcaacctcaagaaaggtggaatggaccaggtgcagtggctcacacttgcaattccagcactttgggaggccgaggtgggaggatcacttgaaaccaggagtttgagaccaacttgggcaacatggggagaccccagctctacaaaaaataaaaaattagccaggcatggttgcacactcctatagtccaagctatttgggaggctgaggtaggaggatcacttgagcccagaaggttgaggctgcagtgagccatgatcatgccactgcactctagcctgggcaacagagtgagaccttgtctctaaaaagaaagagaaaggtggagtggctatatatatacacatatatatatacatatatatatatatatatgtatatacatatatatatgtatatatatatatgtgtatatatatatatatgtatatatatatatgtgtatatatatattattattattatactttaagttctgggttacatgtgcagaacatgcagttttgttacataggtatacacatgccatggtggtttgctgcacccatcaacccatcacctacattagttatttctcctaatgttatccctcccctagccccccacccccaacaggccctggtgtgtgatgttcccctccctgtgtccatgtgttctcattgttcaactcccacttatgagtgggaacatgcagtgtttggttttctgatcttgtgatagtttgctgagaatgatggtttccagcttcatccatgtccctgcaaaggacatgaactcatccttttttatggctgcatagtattccatggtgtatatgtgccacattttcttaaaacccaaaatcctgtgttttgacagggctctctttgactgaacacagccagctgttaaaccccactaattgctggctgattgttctattgttttcaaaaatccttaagggcctaaattgttccaaaaactggtccaatcaaattctggcacctttgaagcatagttccctagatcagtatttgagatttgttctgataccaggagggctcttctcagctgtctcttctctgtttctctccagtgaactagccagcttacagttaagcctgtatctccaatgaatatattattctcctaccaattaccttttgccacagtctccactgtttttgagaacatctccaaactcttacatctttcattctcttgatggtgtctttcacagaacagaatttttaattttaatgagtccagtttattaactattttttttcatggattgtgcctttggtgttgtatctaaaaagtcattgcaatgtaagttcataaattttaacaaatgtaccactctggtgcaggatgttgatagtggaggagattggttgcatgtatatggagacagggagtgtaggaggtatatggaaactctgtactttctactcaatttttctatgaacctaaaactgctctaaaaaaattttattaatttaagaaaagtttaaatccctagatgaagataaggtgtcaaaattacaaatagactaataatcgaagttttcaaaaagccatcaccatacaccaggtcatttacatgttctctctcgtgttattgtctgggagttttatagttttgcattttacatttaggtctgtgatccattttgagttaacttttgtaaagagtataaagtcaatgtctagatctatttcttttgcatgtggatgtccacttgctcctgcaacatttgttgaaaagactatttttgctccattgttttacctttgctattttgtcaaagatcagttgagtatatgagagtatatttctgtgccttttattctgttccattgatctacttgtctgttcatttaccaataacacactgttttgattcctgcagctttatagtaagtctcaaggttgggcagtgtaagtccttcaactcttcttctccttcaatattgaggcggttattccatgtcttttacctctccatataaactttagaatcagtttgttgatatccacaaaataacttgctgggattttgattggaattgtattgaatccatagatcaagttgggaagaactgacatcttgacaatgttgagttttactattcatgaacgtagactatctccccatttatttagttatttgatttctttcatcatagttttgtagttttcctcacacagatcttgtacagatgatattagatttataccaaaatatttcattttctgtgaatgctaatataaacagtaatttttaaaaacactttattgatgtatgacatacaaaaagctgtgcatatttaatacacgcaacttgatgagtttgagataaatatacaccaaacatatggaatgcttcgcaaatttgcatgtcatccttgcacagaggccatgctaatcttctctgtattgtttcaattttagtatatgtgctactgaagcaaacataatactaatgaatttttaatttcaaattccacttgttcattgctggtatatagcaccgcaattgactttgtatattaaccttgtgtcctgcaaccttgtataattgcttattagttctaggagtttatttattgattctttcagattttctgcatagatgatcatgtcatctgtgaacacagacagttttatttcttccttcccaatctatttaccttttatttctcattgcattacctaggccttccagtaaaatgttgagaagcaagtggtgagaggggacatccttgccttgttctttgggaaagtttcaaatttctcaccattaagtatgatgttagccataggttttgtgtagatgctctttataaagttgaggatatcctttctatttctagtttgctaagagtttttatcatgaatgagtgctggcatttttgtcaaaagctttttctgcatctatagatacaatcgctatttttctttactagcctattgatgtgattgattacattatttgattcttgaatcttgaaccagcctttcatgcctggggtaaatcccacttggttgtgatgtataattatttttatacattgctggattcaatttgctaatattttgtcgaggatttttgcatctatatttatgagaaatattggtctgtggttttcttttctcgttatgacttcatctgattttggtctttgggtaatgctggcttcacagaatgagttaggaagtgttccttctgcttctatcttctaaaccagattgtagagaattggtataaattttccttaaatgtttgacagatttcaccagtgaacccatctgaacttggtgctttctgttttgaaaggttattaattactgatttaatttatttaatagatatatgactattcagattatcaatttctttttgtgtaagctttggcaaactgtgtcattcaaggaattggttcatttcatctagtctattgaatttgtgggcatagagttgttctttgtattcttttattattcttttggtgtccatggaatttgtactgatgttcccccctctttcatttgtaatattagtcatttgtgttctctttttttcttagcctagctagaggcttattgattttattgatcttttaaaagaagcagcttttggttttgttgattttttctccaatgattttctgcttttggtttcattgatttctgccctaatttttatttcttttcttctgcttactttgggtttagttcgctttttcttctattttccaaaggtggaagcttaggtttttcttcttttctaatatatacattcttcatttctaatatgtacatgctataaatttccttctaagcactgcttttgctgcatccctcaaattttgatatattttcattttcatttagttcaatatattttgtatttctcttgagattttttctttgatccatgttttatttagaaatatattgtttaatctccaagtatttcaggattttctagacgtctttctgttattgatttctatttcaattccattgtagtctgagagcagacattatatgattgctattcctttaaacttgtaaaagtgtgttttatggcccataaaaaagtattaactgttgtcagatttatcctcactgagcatccaacaattcatcaattacaattcaggttttcctactccagtactgatttctgttcatgagtttctcttcccatgagttgtgattctctgtgttcatctgtctgtctctaattttgagggcagaggtttgccctgtgacctcatttctctgattaatctaagaagaggtattgatttttcagtgtgttcagctttttacttgttaggatggggagcgacttctaagctgcgtgcatgttaaccggaagtcaatctttttttttttttttaagagacagggtctctgccccattgtccaggctggagtgcagtggtacaatcatagctcattgtaacctcatattcttgggctcaagcaatgttcctgcctcagcctccctagtatctgggaccacaggcacacaccaccatgcctggctaatttatttaattttttgtagagatgggggtcttactatgttgcacaggctggtctggaactcctggcctcaagcagtcctcctaccttggcctcccaaagtgctgggatgacaaagagcagtggcatgagccactgctcttcacactgtcatgcttgaagtggaacctgccacttcatttcatactgctgaataatattccattccatcttatagctataccacattttatttatccatttactagttgatacacatttgtgctgtttctactttttggatattatgaataatgctgcaataaatatttatgtaatgtgagctctttctgcccttttttgtatggcatcctttgatgcacaaaaatttttcaccttgattaagtttaacttgtcaatctttttttttgcttgtgtttttggtgtcatatgtaggaaatcattgcctaacccaatatcatgcagattttcttccatgttttattctaagagttttatagttttagcttttacatttagtctataatcttctttaatttttgtgtataatctcagatagaggtcctactttattcctttgcatgtggctatccagttgttcagaattatttgttaaaaagacttttctttccccatttaattatcttgatatctttgtcaaaaatcagttgaccataattttagggtttctttatcatctcttgcttattcagttgatctaaatatctagtcttgtgctagcaccatgcagtcttgattattgtagctttgtggtaagttttgatattggaaagtataaatcccccaagtttgctgttctttttcaagaacattttggctattctgagcccctttcatttccatatggattgtaggatcagcttgtcaacttctgccaaaaaagatagctgggattttcacagggattgtgttgaatctgtagataaatttgggccatgtagctatcttaacaatattaaattttctgatatatgaacatgagatgttttcccatttatttatatcttttaagattttttcaaccatgttttctagttttcgaagtaagaaatttttacttcttttgttaaatttatccctcctttttttttatgcttttgtaagttgaacggttttctttttttcttttttttttttctttttttttttttgagacagtctcgctctgttgcccaggctggagtgcaatggcgcaatcttggttcactgcaacctccaccgcctgggttcaagcgattctcctgcttcagcctccccagtagctgggattacaggcacccaccactgcgcatggctaatttttgtatttttagtagagacggggtttccccatgttggccaggctggtttcgaactcctgacctcaggtgatccactcgcttcagcctctcaaagtgctgggattacaggcgtgagccatcacgtccggccaaatggttttcttaatttcatttagcaaacttgttgaatttgtttattaattctcatagatttttagtggtttccttaggattttctatatacaaggtcatattatctacaaatagagatagttttacttcttcctttttaatctgtatgccttttgtttctttttctttttaaactaattgctctagctagaacctccattacaatgctgaacagaggtagtgagaacaaacacccttgtcttagggaaaagctttctgtttttcaccattaagtatggtattggctgtgggtttttcgtagatgcatttatcaggttgggatgtttccttctatttctagtatgttgagtgtttttatcataaacaggtgttagattttgtcagatagttttctgcatctgttgaaatcagcgtgtggttttggccctttattctaatgatttttaattcattttcagatgttaaaccaacttaaaattcctgggataaatctcttttgttcatgtataatcttttttatatatagctatatttgatctgctagtgttttgttgaggactttgcatctatatttataaggcctgtaggtttcttttcttgtgatgtccttttctggctttggtatcagaataatgctggcctcacagaatgagtctggaaatgtttgtttcttccccgtttttggaagagtttgtgaatttttctttaaatgttttgtagaattcatcagtaaagccatctgggcctggacttttttatgggaagttttaaaattattaattcagtctctttgtttgttataagtctattcggattttctatttcttcttgggtcagttgctagaagctgttctttctaggaatttgtctattttatctaagttaccgaatttgttgccatatagttgttcatagtatttgtttatttctctttttatttctgtaaggtcagtagtgatgagtcttttctagttttctttttgtcagtctagttaaagatttgttaattttgttcttttttttttttcaaataaccaacttttggtttctttaattttctctacttttctaatatttatttcatttatttcctcttttattatttccttccttcttcttgctttgaatttagtttgcttttctttcactcgttccttaagccatttttgctttttgaattttctcttgtaaagagtatcactctgtcacccaggctggagtgcagtggtgcagtcattgctaactgcagcctccaactcctgggctcaagcaatcctcctgcctcagcctccctagtagttaggactacaggtgtgcgccaccatgctgggttaattttttaattttttgtagagccacggtcttgctatattgcccagcctagtctcaaactcctggcctgaagtgatcttcctgcttcagcctcagttttgctttttgttttctatatgtttcacatcttttttttttaacctctgttcctcttttactgccttgttttgcattaagtattttctagtgtagcattttaattcatttaattattttttaactttttaaaaaagtttttttcttaattgttatcctaaggtttatgatatacaccttaacttgtcagaatctacttcagatttgtagtaagttaattccagtgagacacagaaactttatttttatatagctcccttccccatttttgtgctattgttattatatgtattatgtccatgtgtgttacaaatctaacaacacttggttacagttattactttatgtaatcttatgtcttttaaagaagctaatagaagaaaagagagcatggatatatttatagagtttaaaaaatactaaccttcttaattaccattgctggttctcttcatttgttcctgtggatttgagttaccatctagtgtcatttccttattccagtgcagctctgttcccaacaacctcctttaccctattgttgtcaaatatattatatttttatatattttatggaaaacaatgcaattttatagatattgtttatgaaattgctttctaaattatttaagaaaataggaaaaatatgtaattattcttatatcattacctacataactacctttactggagctctttggttatttgtgcgaatttaaattgctgtctcagccaggtgtagtggcatgcacctgtagtcccagctgctttggatactgaggcaggaggatggttttagcccaggagtttgaggctgcattgagctatgattatcccactgcattccatcctgggcaacagagcgagcccccatctcttaaaaaaattgctatctaatgtcactcccttttagcctgagaaacttcctttagtgttttctgtaagtgacaatggattcacttagtatttgtttctatgggaatgtctttattttacttttttttttttctgagatggagtttcactcttgtttccaggctggagtgcaatggtatgatctcggcttactgcaacctccacctcccaggttcaagcgattttcttgcctcagcctcccaagtagctgggattacaggtgcgtgccaccatgcctggctaatttttgtatttttagtagagacggggtttcaccatgttggccaggctggtctcaaactcctgacctcaggtgatctgccctccttggcctcccaaagtgctgggattaaaggcatgagccaccgcgcccggcctattttgctttcatttttaaatgatagttatgctgggcttaagggttgacagtttgtctgtttgtttgtttactttctgcattttgaatatgtcatctcaataccttctgctctccgctgtttctgttgagaagttagctgttaatcttattgaggtttccttgtacatgatggataagttaagtgtttcctcctgctttcaaaattttctctttgtctttcaatacttcattatttcagcaactgtgatacatctgggcgtggatctctttgtctttatcctgctagaagttcattgagcttattagatgtgcatattaatgtttttaatcaaatttgagttgtttgaagccagtatttcattaaatattttgtctgtccctatctctgtcatctctccttctggtactaccactatgtatgtaatatgttggtgcacttaatgctgtcttacacttctctgaggctctgttcattttgttgttgttgttgttcttcagactgaaaaatctctattgcctatctttattgttgtgtgtgtgtgtgtgtgtgtgtgtgtgtgtgtgtttggcttggagactgctttcacaggtcaagaagtttacaattttgctccatgttcaacaagaactattactttagttttctctccagtcattcctgagagggcctagtcttaggcatatgtacagtctttcagacctccaaggatgagtgtgatttaattttaagcctggctgcctaggagtgggccctggtttagggtagcttattgttcagtcagtgatttgtcacaggttgtgagccagtaaggctgtcctttgttgcttgaattgtgtgtggcttgaggaatgttttgcagtctgtcccacgtcctgccttgattgctcctgaagtaggtgcagcctagtgcatgtgcacagccttccaagtccatagggatgagtatgatcccatgaggtgtcttcttagctgtttctttccatggttttctctggcaaccttctggctggtctgccatttttcttgttgctactagtttcatgaagctaccagccgtcttaactgcttgccgtgaagatctccattgttttcgacagtgccctcaggcatgaacttctccatgctctgttctaaataacgagcccccttaggacagaactgtggagctctccatccttaaggcttgccttcagggtctgcctctaagccactgccctggagctgggggtggggagagttcctggttctcctggagtgacaccccttactctaagagtgggtactggggaggtggggaggggataggagtccctgatcttctcagcttgcctctcccagtatggagcttgcatcctattagccagctgtggtaggatgattgaggcctagcattcttggcccgttgtgcctggggtaaagattctgccctacaagctgggactgggtgggagaaggaagcccagtcctcttggccactttcacccagaatagaacttctgcaatactgagctgggagagatgagacatgctcctggagtgaagctgaaacccgtagacttggagctggggaaatagagaaccttgctttcttggccacacccatccagaacagcgcttctgtaacatggagctggtgaggggcagaactggagcaggtcatggctcagatgtcacagactgtatctgttcttaccaatatttagtagattttcttgaataaatgtttctccacttactgtgtgctctgaggaaaatttccagagactttaaatggttatttaaaaaactttcaccagcgaaatgattgtttcactgaggaaaagcatctacttccaacacagccattctgtaagtcctgtccccttactgaaaattgtgacagtggaaaaaaattttttggtgtgggcttctctgtatatcatctctactagaactcaattaagcccaaactcaagattttattcaggaggaaagaaagcatatagaacagtgaaatggtgttacaatgtgaggcttactttaaaaaaaataaagagtttcagacttatcacataaatgttgacgttttgcaaagtagctattctccagaataaggcattaatcagaaggggaaacagtagtaattatgtgtaaaacattctgatccctggagcagcagaaataatctcatccctgggaacccttgtgggttaagtagggccttctctgctgttgctccagctatggttttgatatttctttctaattttttatagagaaaaactatcatcagtaaatattggcaagagcacgcaaaatagcccctcatctggtctctagaaacatacaggctgggtccacaaatgcagaaaagcagattgtgacattgctgtgactttgaactgctttagtgatcccttccatgctgactgttggcaaaagctcgttttccttctctctgccttgctttctccctccctgaacaatagcaaggctgtggaactcctaccttaatggaaagtgtgatagcgctgtgccactgggacagatacctcctttggatttgataccctctcctcaattgtatctcttcttagcctgctcatccccaccattttatcaatggaatagtcaattttaaagaagtatgggactccaaagagaagattcagccatggcagctgtcacttctcttcccccttgttcagcctgtttgtgtcttgtttgtggacatccactgctccttagtgcctaaagctggcaacctcatatgctggccgcaggactactgggctggagaggcagataccaacccatctgtgccctggcgacactccgctatttgcctttgcaagagaagttcacaccgaggagtgactgctggagacaattaccaccacagtggtgacctggcctttcagtttcttaccctgaactcctctgatttactctctccatcattcatacacccatttttatcaagatatcactctttaaatctctgttgggagcacaacctctctcctcccacagcttcccagcacacctgcagtatggtctcttggcttttgcccaaacatttgtattttagacactgcttctccacaccccacacttgtctctccgtctctctcttcctttcccctctctccccatcagtaaatgctttcaattgcttctctaaagagcctataccccgtgataccctcctttccttgaccttagacccttcttattatgacaattattatctccaggcccattccctgccccttcccctggctgttttctctcctcctcctgttggctctgagcttgctttctttatagtgatggtactttttttctctcccaaactagctccttcctcatcaccattcctcccagcatcctggtttgcagcagtcaggtgaaagagagaagcaggtcccggagggtcttggggcatgtccctctctgtctcagggagaaagctgctgctggccctaccactagtatcctgtgagaataacagcccagtgctgccagaacctataggtcttcaagagaagatagaaactccagattttaatgtaaactgtctcacttttaaatgttgaaaactattctttttttccccaagaacctggggaaagtagcaaaaccccccacatctctgggctagatttaactcccctatctcccacattaactcagttgcccagttctggaaagctgcctgctaaggacatatcctccatttcactggcccactgtggtccctgcctttaagccttgtcacctggatgactataatggccacctaactggtctctctgcttcatgcccctccccgcccagtctactgtatacaacataattgcctcaaaataacagagtcttgtggtgaagggcttgtactctgggatctggctgtgtagatttagtcccagctgccatttataagctaggtaatcttgggcaagttagttcacctttctgaatctctgtttccttacctgcaaaataggaaaaatagttatacctcctcataggcctgttgtgaggacttagtaagcctgttgtgaggacttagtaaagaaccatgcctaagctggaataagtactcaataaatgttaaacaaaattgtgtcatcccctgttgcaaagacctccaaaggctccaatgcctcttaaatacagtttagcccctttgtctagacattcaagaccctcttgatctggcttcagccacactaggctcctgtcttattaatttttttctcccctgcagtgctatatgttctcactacctctacactttcatcccccgcagtaacctgtgaggcagctgctatgattatcctcatttcacagatgagcaaactgaggctaagtgtcctgcccaaggcctcccgacctggaagtggaggaagcaggatttgactccagatctgtctgactaaagcctgttgtctttccactagaccgtagagagggaaaaacacacagtgacaggaagacatgagagagacttgcgattcacttctccctagggaaaaccacagagcattgttttttctccatgagaaaccaatctgaaagagtggtgtaaccatgtgagaatgatacggggtgggttggggccaggatatgctgatgcttgtgaaaactgctgaagtcagcacaagggacttttaaaactagatttagaacaagttgcaaagcaagaaaggattggccagctgctttggggccaacagggtaatattactttttggctccttttgtaacaggtgtggttaagctctcccttaaaggctttggcaagatgaggttagcatagcagttaggtgccccagatggagaaacagaattctcaggttcaaatctccattttgccacttaaatctgtgtaaccttggaaatgttatgtctcgttttctcatctgtaaagtggcagataataataacacctacctcacagggttgttgtgatgattaaataaaatagtacatgaaagctctcagaacattgcctcacacacagtaagttattttataaacagtagctagtatttgtccttcatgaatatatgtgctcaaacttggtggcagtctctctctctcttttttttttttttttgacagcgcctcactttgtcattcaggctggagtgcagtggcacaatcttgacttactgcagtctcaacctcctgggctcaagtgatcctcccacctcagccccccagtagctgggactacaggtgtgtgccaccatgcccagctaattttttgtagagacaggctttcgtcatgttgcttagcctggtctcaaattcccgagctcaagcgatccaccctcctcggcctcccagagtgcgaggattacaggcatgagccaccgcgcctgtctggtctctcttctttcttgacctattccaaaaaccaagaccatggccgcaccttctatttgtagacatttagaaactttccaaagtgctccagacacctcattaggaggatggtggaaagtttctgaaatcttaaacaactttctagaaggaggtgaccatactcttttatcccacctcccttattacatactgcttgcatttgtacagcccactagtataagtgcacagactctggagaggggtggcctgggttcagattccatccttgctacttactctctgtgtggccatgggaagttacctaacctcccttgacctcaattgtctcatgtgtaaaaaaaagagataagaataacaactctatcatggggttgttatgaggattaaacaaattaattcatctaaagtgcttagcgcagtacctaccacataagaagccttaatcaaagtagctgttctcattactattagaaaataaactaagaaatcattaggcatcccttaaacttctcttttaggttttcctttactagctagttctcacatcaccttacattctcagcccctgattagagcactcgcctttataagggaatcttggactgccgtcatatccctcccttggacctgccaacccctgcccttgggtggtgctttatacccaactgcagccataaggctctcatttggtgccaggactctgcacagaacagcttctgaggtaatcctccatagactgtcaagcccaaaaagccactcgctataggtccttaacctcattctgcataggactagaagaaagatgtttcccagccagacacactttattcagtcatggaggagttgaatggcacccctgcatcagatcagaagctgctggcacattcagtactgctattcaggctactgcttatatttctgttaggctggccctggccctggcatcatttagcctatcttgggctcacatcttttttttttttttttgagatgaaatctcctatatctgttgcctctcattttactacagaaacttgtcaaggtttttttttttttttttaattatactgtaagttttagggtacatgtgcacaacgtgcaggtttgttacacatgtatacatgtgccatgttggtgtgctgcacccattagctcgtcacttacattaggtatatctcctaatgctatccctccaccctccccccaccccacaacagtccccagtgtgtgatgtttcccttcctgtgtccaagtgttctcattgttcagttcccacctatgagtgagaacatgcggtgtttggttttttgtccttgcgatagtttgctgagaatgatggtttccagcttcatccatgtccctacaaaggacatcaactcgtcctttttatggctgcatagtattccatggtgtatatgtgccacattttcttaatccagtcgatcattgatggacatttgagttggttccaagtctttgctattgtgaatagtgccacagtaaacatacgtgtgcatgtgtgtttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacgtcctctccagcacctgttgtctcctgactttttaatgatcgccattctaactggtgtgagatggtatctcattgtggttttgatttgcatttctctgatggccagtgatgatgagcattttttcacatgtctgttggctgcataaatgtcttcttttgagaagtgtctgttcatatccttcacccactttttgatggggttgtttgtttttttcttgtaaatttgtttaagttctttgtagattctggatattagccctttgtcagataagtagattgcaaaaattttttcccattctgtaggttgcctgttcactctgatggtattttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaaaggatccagtttcagctttctacatatggctatccagttttcccagcaccatttattaaatagggaatcctttccccatttcttgtatttgtcaggtttgtcaaagatcagatggttgtagatgtgtggaattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgagctctaaagtagttttttccaattctgtgaagaaagtcattggtagcttgatggggatggcattgaatctgtaaattaccttgggcagtatggccattttcacgatattgattcttcctaaccatgaacatggaatgttcttccatttgtttgtgtcctcttttattttgttgttgggctcacatcttgcccaacatcagctgttgtcaacaacacctgtgctcatctaatcatttagctcaggtgtctcaagcactttttacatgccaaacagtgtgtgtgtgtgtgtgtggggtgtgtggggtgtgtgtgtgtgtgtgtgtgtgtgtgtgtgtgtgtgtagtgtgtgtacatatgtgcataaggataagttgaaagagtcaatgaacagaatgaagcctacttgcaatccagtgcagcactgtgagtctgggctttggagacagatgggcctgatgcaaatcctagctctgcttcttgtcagttgggcaatgtgggacaagttaatctgtcttactttgatcagctataaaaggaggatagtagaaagatataccgtgaagagttactgcaaaaataagaggtagcatatgtgagtgcctgatagagacctaatcaatgatttttgtaattattattttccctagacccaattctcaactagggtgttgccccttgaaattaaaaaggagaatctacatgcaaaaatgaataatttggactcctaaccttatatcatgtacaaaagttagctcaaagtggatcaacgacataactgtaagagctcaagctgtaaaaccgttagaagacagtgtagttgtatatctttgtaaccttgaatcaggcaatggtttcttagatataacaccaaaggcacaaaagacaaaagaaaaactaggtaaattgaactttatgaaaagtaaaaaactttgtgcttcagaggttaccaagaaagggaaaagacagcccaaagaatggacaaaagttttgtaaatcttatggccaggtacagtggctcacgccagtaatcccagcactttgggccaaggcgggtggatcacttgaggtcaggagttcaagaccaacatggcaaacatggcgaaaccccatctctttttaaaatacgaaaattagctgagtgtgttggcacacacctgtagtcccagctactcaggaggctgaggcacaagaattgtttgaacccaggttgcagtgagcagagatcgtgccactgcactccaacctgggcaacagagcaagactctgtctcaaaaaaaaaaaaaaaaaagaaggtttgcaaatcatatatctagtaaagaacttgtatccagaatatataaagaactcttaaaactcaacaataaaaagacaaacaactcaatttaaaaatgaacaaagatctgaatagacagttctccaaagaagatatacaaatggccaacaagtacatgaaaagatgttcaacatcattatccatgagggaaatttaaatcaaaccacatgagatcccacttcccacccaatagatttgttgtaatcaaacatacaaataataagtgttgacaaggatgtggagtgactggaaatctcaaataccactggtaggaacataaaatggtgcagcctctatggaaaacagtacagcagttacacaaaaggttaaacatatgacccaggttaccgtatgacccagtaattccactcttaggtacatactcaagagaaataaaagcatatgtccccataaaaaaaagcttgtacataaatgttcataggagcattatttgtaatagccaaaagatggaaacaacccaaatgtccttcaatgtgtgagtggataaacagttgtggtatattcatatgatggaaccagtcataaaaatgaatgaagtactgatatatgctacaacatggatgaaccttgaaaacactaggctaagcaaaagaagccagacacaaagcccatatactgtatgattccatttctataaaatgcccagattaggcaaatccataaagacagaaaatagactagttgttgccaggggctggagtggggaggataatagagagctaataagttagggtttcttttggggggtgtgatgttatgaaatatatatttggtctttgtctccatttcctggcatacaactccgaaaatccttggagtctccaaagtgatgtctttttgtatgcctatgagttgactgatggttgggtagcccaagaatagggactggtcactggaaagaccaaggcatgaatagagggttgggactttcagcccaacctccagggacgggagaggggctgaaggtgaagttgatcaccaatggccaatcatttaaacaatcatgcttacataatgaagcctccacaaaaactcaaaagaacagggtccagtgagcttctggatagctgaacacgtgaagattcatggagggtggcctacccaagtagaacatggaagttctgtgccccttcccacataccttccttgcttgatgcatctcttcatctgtatcattttttatgtcctttattatagaccagtaaatgtcagtaagtgcttccctgagttctgtgagctgctttagcaaattaatagaagaaaagagggggtaatgggaactccaatttgaagctggttgtccagaagttccagaggctagaacttgcaactggtgtgtgaagaaggggggacgcagtcttggggactgagccttcaacctgtgggatatgatgctatcttcaggtagatagtatcagaattgaactggaagacatctgtgtctactgtagaattgattgcttatttggcgaatggggagagaaaatcccacacatttggttacagaattttctgtgttgattgttgttgtggtgtgagaacagaggaaaaacagtttgtttttccactatcaccgggaaatgatctaaaattcactatgatgatgggtatacaactctgtgaatatactaaaaagccattgaattgtctgctttaattgattgaattatatgctacgcgaattatatctcagtataaattttgcttggtgctatgtctcacgctggtaatcccagcactttgggaggccgaagtgggaggattgcttgagcccaggacttcaagaccagcctgggcaacatagtgagaccccacctctacaaaaaaaaaaaaaattaaaattagccaagcctggtggcacacacctgaagttccagctactctggaggctgaggtgtggagattactctagcccaggagcttgagggtgcagtgagccatgatcacgccactgttctgtagcctaggcaacagagtgagaccctgtctctaaaaaaaaaataaaactgttaaaggaaaaaaaaggaatgagaaaggaactacccagagccaccacagtggacttgaaaaagttatggttatttcttgatgataagcttaacaaggggtggattattcatgcctcccctttttagaccttatagggtaacttcctgatgttgccatggcatttgtaaactgtcatggtgctggtgggaatgtagcagtgaggatgaccggaggtcactctcatcgccatcttggttttggtgggttttagccagcttctttactacagcctgttttatcagcaagggctttatgacctgtatcttgtgccgaccccctatctcatgctgtgactaagaaggcctaacttactgggaccgcagcccagcaggtctcatccttattttacccagcccctattcaagatggagttgctgtggttcaaacacctctgacatttcccccctcacttttataagagaacccttaatcctaagggttgcagagggacaaagatccatcttctaatgaatagcggtgatgatattcctgtctaactattagatctcttgcaatcagggtagagaggagctcagtcagaaagcattggtatgtcatgggccattcacaattctgagttctgacaaaaggtgatatcttgaagattaataagtattcaatgtaagaaaacattcggtaagcttatcctgcattcctacacaaagagtacaacagcaatatattccacaatagtaaagcaaaataagtaaaattgtccctagtaaactaaattagaaagctttccatgaactaggcatttgttggaaccaagctaatatggggttgctagccaatttcaatatgtgcccagaattggaatactgatccagatttttacattacccatccctcttgtttcttctgagaagcagtcagagatcactggatgattcacaggaataagcagagtcagtataaattgcagaaaaatacttaaaaacaactaatgagactaaaagctaataacaggtataccacaattcttgaaacataattttttctctctccagtctcccatttttactaaaggtaaatcatggtaagactgatttgctttattatacctggttggactgtttgtataaagtgcagcaagaataattatttttcacataagccctttttaaattggctttaatggagctctatttctttcctttttttttttttttgagatggagtcttgctctgtcgcccaggctggagtgcagtggcacgatctcggctcactgcaagctctgcctcccgggttcatgccatcctcctgcctcagcctcctgagtagctgggactacaggcacctgccaccatgcccggctaagtttttgtatttttagtagagatggggtttcactgtgttagccaggatggtgtcgatctcctgacctcgtggtccgcccaccttggcctcccaaagtgctgggattacaggcatgagccaccgtgcccggctgatggagctctgtttcatagatggaatctcagatctttttaaagccgagcccagccatggatttgtgccctcaaatacccataagttgagtaaatccctctccccttgaggtcccaagataacttggggctcctgggcctgtcagaaggtgacattctttaaacttaccacaggtcaggaaccttgtacaggaactgtgtagacaaggtatgaggccagtttcccaaggggcttttattggctctataagtcaagtttgattccttaaaggaaagcacaccattccattcaaagccttggtaaaataaccagtttctcaaattgtgtcctgttgcaaaagaaaacagattcttattgcacttatgcaaataactattgctataagttaagaacactcacaactagtttccaaattctggagaaatcaggtagagagaaacaaatatgctccaagttttattcccaggaatatactttactcaattgttaaaagctgtaaatagcttaaaagaaaagtttctttgactctgaaaaacaaaacaaaaggatccgcaatgctttaagctaagttaaaaaagattgcttcagtcttctattaggtcagtccattcagtcaactcctgttctgctttatattcatgaacatttcagctttccatgagtcttgaaagtttttcctctattctaatgtcataatctccaaagttattagaaacctgcattcaagaacacctgttagagtcctgtagctgattataaaccaccttttaaagaggatcaaaacaagacaacaattgcctgtggatgacaaaatgtcttagggcagccacagccaaaaacatgattgacaaagaaatttggttacctctacggcacacaatgattttatgtaataattataattattactgataatatatgctaagttatattaggattataagagtttcccataattttgaacacataccaataacatatttctagaaatacagcccaaaaaagccaaacaccatcttatatttgagaatgtttcctgtatgacttttataccaaataagccaaatgtcacttttggactttaggcaacctaatatctaaaagattaattaggtcagaaaaagtcatagtttataatttcactttggaaagcttatcaaatattaaaggcttaagtcacttgatattataaaaagaatcccaggtcaccgtaagtcactcatttaaccaaaatgataaatattttaaaaaggcaaaaccccatactcactaagagaggagagaatcagctttctaaacaagacccaataaagacagcatgaggccaattgaatcttgaatctgtcttttctttttcccctccctttttccctgccatttatccaaagtcatagacaaaaacctttcattatcttttcatattatgtaaaaatcttttttgaaacagaaaaccaaatttcatatttgcattagtgcatttttcatgccaaagctagttttaaataacattttataagtttatccagttttaattagtttgaccataaggtatgattttcataaacctcttataactctttataatttttgttaaacagatcaatcttctaagaaaaccctgttatttggacacgtgggcccaaattctggcaccaaatcagtatgcttttagtccaatgttcagtttatggaaaaactgaatacccctttaatttgagcgaatatgttcacacacagaatttcttttacaagattaatttttcacaaaccttccataacttgctcaaaccttcagctttatcttatctaacttaaaacaatccgttaaccctttaatctaggcaagaaaaaaaaatccacattcccatgcctttttataatcttttaccaaaaacacatttcactttctttacacactttgcatgtaaaactgtttctttaagctgggcgcggtgactcacgcctgtaatcccagctactcgggaggctgaggcatgagaatggtgtgaacccaagaggtggagcttgcagtgagctgagatcgcaccactgcactccagcctgggcgacagagcgagactccgtatcaaaaaaaaaagaaaaagaaaaactgtttctttagtagtctcaaatacgtgttacacggttaattcttagcaacttttacttttggtgaaaagcttggctagtaagccattgtagttaggtaccaggtctggagtctagaacatcagacagaagtacagataaaggctgactctttccagcatacgtagggggcatggctgtccatatgtccccaggccttatctagaatctaatgctccaaggtagtaggtaaattgaacaattttcaaaagtcaaagaagcagtttatgaccttaaagcatttagcaaagctagtatgtgaccgaatttagaccaaatgtctaaattttgaagacatttttattttaccagtaacctttaaaactgtttttatttcccaaagattactaaagtcacatgaaccaaaaggctttgtacttttacttttctgataaaatatttgatttaagctcttatttttaaaccaattaatcaaaacccttttatactacacacacaacacatatacatacacagacagacagaagataaaagagtcattccctaagccaggaattgaaccctgaagccaggccaccacggtgaagacacaaagccttagctactgagctacagcactgggaagtttccatttctcttcctagaaggagcctagaacagccaattttgaacttgcaaaagcttttaactgcttgagataattttaagggctaactataacatgaaaccccaaattcctgtccactggatgatggcaaccaagagaaagtactgccacgtggttacaaggttaagctcccaaggacatttttcaacatgtagtctctggcgagacagtcgccctgagtaacagacaagataagaaatggaaaagagagaaagaaagagagaaaaacattgctgcggcaggatggggaaggcgagttgctcacggaggccagagaaagatccacccattgcaatgccactgaaaagttcaggttttgttgaagggatcttttttgaaggttttgtttgtcaaagggatcttttccagcattcccatcagctctcaagtttccccctttagggaggaaaaagctccccatgtccaatgatcctgtatatacctaatcttgtcacctacagccatcagcaaaggcagattaattcaaagagaatagcagttaatagtagtgccaaactcgttcttagtcgagagggactttactgagagggatctccaaccccctaaatcttagaagggactctaacgctcctaagttgggcttctaacccaaggtcagtcaagcgtccttgacttttattaagaggggtctttaaccttctctgtcttaggagagacactaactcccctaaattgggcctctaactcaatcccatcttttacactggtaaatgcaccccacttacccaaagtcggccaactggtgctgcagactatttcctttgggttgggggtctcctcagtatcgttccttcagggtttgccagaaagatgttaccagaaaagggtccagatccagaccccaagagagagttcttggatctcgcgcaagaaagaatttggggtgagtccatagagtaaagtgaaagcaagtttattaagaaattgaaggaataggagaatggctactccataggcagagcagtctgtttaccaatttctggttatctgttgacttcctgccaagctagttaaagatttagcaccattgtctaactcatcactattttgtattcttttttggttaccccagtaagctatgcaatatactaacactttctatgtttttgttccatcaagtatgagctgcatcttttgagtccccacttggtaggctaaggtagtggcacccttcttcttcccctcagctctgtaccccacccacccttctcaccaggtggtgctttggcaaaacacttggtccttattttgaaagaccttgtctttaaaaatacaaaaaattagccgggcgtggtggcacgcgcctatagtgccagctactcgggaggctgaggcaggagaatggcgtgaacccgggaggcggaacttgcagtaagtcgagatcgctccactgcactccagcctgggcgacagagcaagactccgtctcaaaaaaaaaaaaaaaaaaaaggtggaagatgtgaaagataaaactaatttttattaagcatttactatgtgccaggaactatgcatgcatcatcacatttaatccttatcgtagtcctgggagggaaatatcataattgcaattttagaaatgagaaaactgtgaccagaccatgcatctggtagggggtcaagctgagatttgaagcaaagttgaatccaaagcccctactattttttccagagccccaagcatccttcaacttcagtttcatctgcagattttcaagtctcttttctgtagcgaaggcttggactagcagtctttagctatttttagaaccccacagtgattcctgctcattcaccaatgctgcagcctcttcccagagggcaaagaaaagggtgacttgagaggaacctgaaggcaaatgaaccatccctatggggtgtggggagagtagatcatctggatgggtttgctgattcagttgcatgcctggcaggcttctctctacctcgtggctcgggcattgagctttggaagccagtacagaagtcccacgtggtccctgaggtgacatgggaatcattttaccgcatcaccagggctccgcctgccagcatgctgcctttgatttgagaagcaaatacagaattttgaagattgtagctgactcagaccattgttctggcattgcggtcatagacacatgtgggaaattcccaaattgactttcccacagagctgctttggagtgggggacaaaaagagttcgggggcggagaatgtattttagttatttatttgattagtgcttgttaaatctttggactgtttcaactagaggcactgaatgggatttccccaggggtcacttctgggcatctagaagagtcaagaggtcaaaaggcccagactcaattttccatactgaggaaggagaggctaataacataaaacagacagtcccagattctttctattggtctacaggctgctgtcacagaaaaacatttggacgttcccacccacatactttcccccaacccatgtcctctgggttctccctctctgttggcgatccagccatccagcccacctaggagtcatcttcattctaccatctccttgcctcataacaacccttctccttcacccgtgggccaccccttctacacacacacacacccatacccaagaccaccccgctcacactgttgatttgcagggtcttacacattcaccctttctcctttcttgttagtgacctccaacctcatcacctcaggcctactactttctgtgcctccagttacacctcccacaacactggcctggccccaatccatcttgtcaacactgctagatgaatcttcctgcagaacagctttccaaggcctgctcagacttccccaaggcttctctgctgcttccagcataaaatccaaatgcctcagcctggttttcgagaccccattctacctgctctctatttctatttccaagctctgttcttgccacttccctactggactgagaacttcttgaagatgaagaacaagcctggctaactactggggctgtgacaggacaggagagtgtctaggacattgggagtcaggacctgtttgctgagggagtgaaggaatgaaagaatgagcgtggttaagccatcacaagactcattttgccaaatagttgtgcagggtcctctgtcactgaccagttgggtgaccttgaataagtcccttcctctttctgggcttcgtgtcttcaacaggtgtctcaaacttgcagctcttgggcccaaagggcctgcaaacatgttttgttggttggcacattaacgtgattttgaatgcctttctggaaagcgtgtgtgctgtggttccccactcttctcccattttcttacacctccccacctcccttattttcattagctgcttggtgcctaaaggcatttacatttgtgactcttggattaggtggtgtttactcacctttcaactctggcgtggctggaattctctgtttgacctgctttgaaatgaaaattgcaagtgctttgcttaagtgattcccagtgtcatctaatatacagcagtcaggccagactaactttgccttcccaaaacaggccaccaaagaacagtggaatatgccgttagtatttctgactttggcagtcagctgcagagggagattttattccattgaaaataattgtctttacatagcccagcacaagtggtgcccatttatagactagaaaggaccaagcacagcgtgcctattggcagccagctgggcctatacagagggcactggttgcaggcacaaagtgtgaatttagcccaagttgcctagcccagtcctttccagaacaaagtgctgaatgaggggtgtgtgctagaagcatttctctctctctgtctctctatgtctctctgtgtgtctttctctttctctctctctctctctctctctctctctctctgtctttggctgtcagtggcctagtttgcactaagactccatagagatacgcacagagggcagggaagatcaaggaggcattctcatcactgggttcctttgcattagccaggcccaagggccacatgagttgcagatctgcctggccacaggcaggcaaggcacagctcactgggagatgctagacaaacacagcagctgctggaaggcacttgcgtagtctggacagcaactgagtcccacacatttgggcagcatctgggtgaaaggtactgggaggtgggcagagagggctggtgtgggtgtatgtgcccatcactgggcatagtcaggcactgggtcaaagtggaagcactgatgacctgtggagccaaatggctgcagtcactgggtgtatgtagagcctgggtgtccccaaaatcagtgtggagggcgtagaggggctattcagttagggacacataataacatatccacctgtatgtagcagttgtaggcatctgagatagtgggtggggtggggaggtgaggaaggaaaaggggagaagaaagactgtttctgactaagctgtttcatgtgtccagaacaactgcagggagcttcctgggggaaaaagattgactatgtatctttgtctccctgtttctgccctttcctgctctgctgcttaggaactcagggagacaaagccctagtactgtttgtcaaagtcaaatagaatggataaagcaaactttccaaagaaactttatggaacacatttcaaagccctggagaagcaattttagggttttttgttttgtttctttctgtttttggttttctttgcatgactgccactaacttatgtcagcaaggcgttaagtgagacacttaagatcattgcggctgccaggggaagtgggtacacccgcttgtggggctgtaagacagcacagtcgctgaagggcattagagctgggctgggttgggctaggctgtggctgggactgaagaccgtgaacacagcgggacatgatgtggtgttggtatgactgtgggtgtgctgtgtgttatgtacatgtttgtgacagcactgagggacctggctgtagctgtagtgtgtggatttgttccgtgtagcttgaaaccagggtgctctggcagcgacaggaacaagtatgggccacaaagccagagagccccagtgtcagctagatgggaggggcgggaacttttctcaccttcatttccacatagccagctgggcctgtgtctctggcagtagttgctggtgtctgaaggcttttattccacctctaactggcctgcagtattccagctggaagccgtggaagcccacacattgacttgtgccgtttctggcacactcagctacccccagtggcctggaagcccagcttttcctgcatagcccttggttgaagacccatacctgagccttatgttcagcgaaaggccttatcatcacacagtgaggcttcctgctaaaatgcaatcgcctactgagatgggagccatggaggggattctggggttgctgttctctatcttttgagtaactgggggtcaaggtaagccaagccctggcctggtctgcagctgctgtctgcacactgcccagcctctccacccacttccaccatcacaaggagagctcttgagtaccctggagggtctgaggtagacatgatggtcctgtaggtggtgggcatttgggttgtcatccccatagctactaaccagctggccaggcctggcatggtatggaggctctgtctgaatgagccaaggatgctccgtctttagcagcaggacttttgagcagtgagaaggcactggggttccctggccagaggaggcaaatcaaatgcacgcagggctacactccccacctgcctcccagcaggtaccataagggtgagagtcggccaagtgtaagacaagtcacggtgtgaccaaccataatgcctgtctttttacattacttttgaaaacactatgcaggccaaaaccaaaaaaaaaaaaaatatatggccaaaccaaaagcatctgcaagccacattcagccttctggctgccagtttgtatcaaatgtgaaaagcaaaatttagttgtacatcactgagaattcttttggcctggtgaactctttcttggtcttccacatctagctccaatggcatctctgagccactttctctgaccctctccttaggccaaacaaatgcttctcctctctctgatcccttagtatctattgtaacatattagtatattcattcattcattcaataaacctctattgactactctggcaaaggtagtgctggggttacagagatgaacaaataagaaataacccctgccctcgagaagcaaccagcctgattggaggaaagatgggagggcagacagactgagagatccctgagggaggctccctctgtgtgtgtgtgtgtgtgtgtgtgtgtgtgtaaaagttgaggaaggtaggcttcgggtgaaaaggagatggctcagccaggtgctggaggaacaaaatgagtaaatcaagctgaagaggaggcagggccttactggcgcagggagcccctgagcagacccctggagttatggataccaatggcatgttcacgccccagtgtgttgccctatgtgactagtgtttaaggaatgaggacaaaataatctatacctcaaacccctgaggcatgcagtttacctgcatacctgcacatgtacccctgaacctaaaatcaaagtttaaaaaaaggaatgagatgctgtaagtggctgtggatcttggctttttgtcctctgaaggcaatggggagccacctgtgggtttggagctggggagtgatgagtctgatctcagctttgcaaggcccacactagagcctccacgtgttagacagtcaggaagtggggcgagactggtgatggggggccagccagggagctgtgtccccagtgcctggacctgcccactgcatacttgctgagtgagtgagtagatgaatgaggtaggaagggatgtggagagtggctgctgcccccacccctgtttggcaggggtggctttcataggcatccacttgggcatctcataggcatctcagacttgacctattcaaaccagacccctggccttgccccccaaacctgctgctcctgcagttttcaccatctcagttaatggcagtctcaactttccaattgctcaagacccaaacctcaaggtcatttttgactctcatactccacatccactccattagtagtttatgttgtttctacattccaaatatatccagaatcaaaccacttgttaccaccttcaagatctgttctcctgtcatctctcacctgggtaattatttgcagcagcctcctgacaggtctccctgcctattccagcttggatcctctatgctctactctcagcacaacagccggtgtgattcagcaaaaacataagtcaggtcatgtcctttctctgctcaaaaccctctactggatctctatttcagatgaaaagccaacgtccttacaatggcccacaggccctgcatactctatctgaccccctgacctgtaggacctcacctcctgctctcctgctactccttctgcactctgcaccagccacactggcctcctcactgatccccaaacagcctccaggggctttgcatttgctgttccctctgcctagaaatcttttcctctaggtacctgcgtggttcacttcctcacttcaggtctctctacaaatgtcaccttctcaatgaagctttcattgaccatcttattatagaataacacccccagccctgctggtcccctgagcccctccgttgtttcatttttctccaagccagttattgcattctaacttactacatattttactcatttgttttattcattgtctatctctccccacagaatgtaagcttaatgagaacagaaacttttgtctgttttcccctgtggtattcctagtgcctggaccagtgcctggcgcatgggagacactcagtaaggacttatgggatcaatgaataggtggactgtggggatcggtgaggttgtcctgggctatctcagggccatgtgatctgggattctcaggaacagatcacgtaggggaaggagagagccactggactgtaggagttagcaggtctagccagggtgaccttgggcaagtcccttcccctcactgtcctcaatttgtccatttataaagcaatttataatttgatgtgattgtctctaaggacaagcattatgagcctctgggggcaaggtgggggcctggccaactgggctgccattcatgccccctgggcatgagggcagagatcctcactcctgcagttccccatttcttttttgacttctttcaaagcgccatcttatcttcaccccacatctataaacataccatgtcacagctgttcaaatagtgatggggcggtggctgccagtcagcttcattcagccaggccagctgtgctccctgcagtatgcctcactctggcttgaaggcctgggcaaatccagcagtgggatagcatccaccccatttttcagagcaaacaattctatcacacctgccacacaggtaggcccatcgctggagcaacctcacctcctctcctagaccaaactctgtagaagagtctggtctggtttgggccaagtgtttatcaagcatttgttacattaaattttaatccttatgctaaccatgtgaagtaggcattattagactcattttcagaggagaacattgagtctcagaggggttaagagtgctgcccaaggtcccatgcaggacctcttcccccatgcaggagtctcttggaaatctgctgaccaaggtctaggaggctcacccatggttggagcaatgagacaggcagaaaggatgcttcgttcttccttcagctccatccaggccacaggtggagcctaagtggtggaaaacaggccagcccagatggaagtcatcactatcccactggttccctgagggctgagcaggagggaggcgccttcccgtcttgccctgccaggaatgtggggcgtcctgagaggctgggaccagtgagcaatgggggcggtgtgcgagttactccatgtgataaactattttcctttctcattccaaggatcagagagcacttggtgagctgttctttgttccaatggaaacagaatatcagaaaagcccagtgggggacagtcaaagtttcctttgtcttcttgggctaggaggctgaatgggaggactgtggcaaggtgggtggggcagggccactacaagggcaacaaatcggtagaagggggatcaggacaggactctacgacaacaatgggggaagaaaaacccacaaagagctaagaacgtgccagtggggaggccttacagcctccctcgtgcagccttactctatgtggatctgctaagtctgacagtctccagcaaggggctggggagtcacagcacagctagtgctctcctggcccaagatgtgccaaaggccacctccaggaccactgccctccacacgtcctctgaactccctggcccagtctctttactgcccccataacacaatgtgcttctaccaagaatgataggaattcaaatttatcgaagtctttgaaagtttgccaagcactttcccatagctctccaggaggcagaatagcctactggttaggaacacaggctcagggcccatactgcctggctctgccattccactgctgtgcgatcttgggtaagttacttagcctctgtgcctcaggttcctcatctttaaaatgggaataatcacaggatctacatcttaaggctgttttcagattaagttggctaatgtttaggctccctaaaagcagagatttttgtcttttattcattgccatgtccctagggcctaaacaatccctggcacctggcaggtactcaacagatatttattaaatatatataaagggcttaggatgggagctggcacttagcacaacaagtgttagtttttgttgttatcttttgcattctcacaatagttccaacaggagcattctgaatttcatgcatgttagtgttgctcctccttgtaaggttcaagttctaagtcaaggtactgaaggaatatgcaacagacttaaaatggagggcaaaagtttgggccacagaggattaggagtacagctgtcaaatattagtaaaagcattcgttcatccattcattcagtcatctattctacaaatatttcacaaatactcctaagggccaggccctgagctgagagctggggatgtattgaagacaagatagacaagggtttctacatttgaggagcttaacttgtaatggaaggagactagcaaaaacaagtaaagatctaaaaagcacttattagcacttattcagatagcaataagtgttatgaagaaaatcaagtagtataatgggatagagaatggctggggttgtgtatgtgttggggttgctttagtttatggtcagagaaggcatctgaggtaggaacactggcacttttctggggcgtcttggtctcaggtcaaggacctctgttgagagttggcctgtgacaccatatcatcaccacctcatccttctgcctaaggcaggggtaagctgctcagtgtagttctggggatctttacgtggaggtttagtgtgaagggctggagagaagggggctatgaacatgtggcgcctgcataggaaggttctggcattagttgtcctctggcaaaacctattggttgctctaggttaaacgatggtcagtggcctttcagctcccccttcatctttctgcactctcagggaggaggtgtctggccgtggggtcctctccactgctgatctatactcaatgccctcatgccccatgctcattcatgacaccaccttcacacatgcaaacactgcctcatctttcaagatagctcagacaccatcaccagtcacactggagggcccttattcattacctgtttgagcatctccagagcatagtatggaatggatacctaataggtgcttaataaatgaaggaataaatgagtgactgttgttccttctgcttcctcagctgactggctcattcccactcatgcatcaagactcagctcacacatcatcttacatgagaagcctccctcaacctccttgtgtctgacctggggagctcttgttcatccttgatgttccccttgacttcctcagccagaatttggccctcccacctctgaatgctccaccacattctattaccctctatcgtatccatcgctctacaggcactgtctgctactgtcctgtcacctcccctaatctctgattttctcaggcaaggactgtgttttggtcatctctatatccccagcactagcccctagagggcgctcaataaatatttgtgaaattaatggggaaaaaaccgtgaatgaattgtttgtcaattttgcttagagtggtgtgctggggctggcttgtagtggtttgcgagaatcaattgttaaatatttaggaaacgtatgagccagttgttaaatacagccatcattaaaaattaaattatatgagaaaacagaagacaaactgaaattgagagacattctacaaaataaatgaccaactaaatacaatatgggtcctggattggatcctagaatggaagaaagacttcagtagaaaagctggtgaactccaaataagtttgtactttagttaatgttgtactaagtttaatttctcagttttgatcaatgttttataattatgtaagatgtcaacataaggggaagctgggtaaagggtacacagaaactctctgtactgtttttacaactcttctataagtctaaaattatttcaacatttaaaaaaaaattgtcaagttccaatacttcttggttgtttcactttcttcttactcattaacataaatgaaaatatcaaccatcattcatttaggaactgcacttgctcttctgttatggccgaagtttggctattgatatgtgttcagcaaaaatcaatgaaagcattatgggagaatccattggttatatggaatttataataaagagtattatatatttcagtattatctgtaaattgagcacttcacattcttatataagtaaatttataataaacctatgtatgtatgtgtatatttatatatacgtttgtgcattttttttgagagctggttgctgaacacttaccagaacaccaccggtcctacatatgaattatgatctcatcaaacacattgaaggaaagaaaagaacattgcccagcaccttctctgtgcgaggctgtactatccctttgtgttcatcattacaggtgctctttacctcaactctatgaagtgagggtattgtggtctccattttacagataaggatattaaggctaagagaggttaaatgactagactaaggtcaagtattggtatacagtgagccagcattaaactacattcatctgagtccaaagccaattgtattagtatcatattgctgctgtaacacattaccgcaaattcagtggcttaaaacaacacaaatttattatcttacagttctggagggcagacgtctgagattggtctcactggactaaaatcaagatgctagcagggctgcattccttcttaggactctacgggacaatccttttccttgccttttccagcgtgtagtggctgcctgcattccttgacttcaaaaccaaaagtggccattcgagtctttctcacatcccatcaccctgattctgcttctatacatctccttctctgactctgactctccagcctcccgctttcactttataaaaaccctcatgattacattgagcccacccagatgagatgggcagcttctccccatttcagtcaatgtcagctgataagtaactttaactccacctgcaaaccttagttccccttgttatgtaactgaacacattcacaggttccagaggttaggatgtggacatcgttgtgggggctataatcctgtctatcacccttgtgctttttccatgaccttctcctgcctcacctgtcattttagtggtcacaaaatctgatgtggggcctatggaattcttcctgacacctgcattgccacacatctctgtgctctccctttggagtaagatgcccctttcagtcattcacccagccagtcagacagccttgtaggggaatggcttctaaatcctggggcttttaatcgtggacatatattttacctatgttcttactaaagtgttttaaaaaaatactttccaagatttttgtgcattcctggctttttacttcctttccacagtgcttatatggtgccagagccctcctttccaacatggctggtttcgctgtgctacggtttacccattcccaccttctggacctgtttctagtcagcagctaggatcatgcattatttatttgttcttctcatagacttttacattgccttcttctggaaatggccctggacttaactaaaatgtacttttcccacccctgccaatgaggtatatgtctgtctgtgtttactatttctctctgactggcttctcagaaacagactctctaagtaacagtttcccatcttcccttgtttcctccacactgagatccctaattcttgtcacgagaaacctcctccactgagaccaaccgaatggccagaagttgcccctccccccaggaagccttaacagccagacccatctcttcaccgcttgtgagctctgactacaacattcttgtctctaccttcagtcttgtcaacagctctttgctcctcctttctacctgtcagacttacacccatactttggggcccagtctgaatcctaccttaaggtaggctcaccttgaggaaaactttccagatcatcccagcccaagggactcatgtcctctgtatgtgtctaggacttattgtcagcagcacttattttgacaaatttatcatctaccattatggagaggttgcaaactgttggctggtgagccaaataataatgcccacaggtgtattttgtttagtctgcatgtggtttgtttctttttaaactatgtgctaacatgtagcaattagtaatctttccatacaatctggatttctagcttctttgaaaaacagaaaaatctggtaatactggatctgtatgcccccaagacagtagttagctagattggcatggccgggtggcagcttccactttagatggagtatgtgctctccagctagacacagtccccactactccgtattgtctcactccaacctcattcactcatttatagtaccttcctggctcctaaaggcatttgagttatctgacatatttcacacctgcctaagtttccagctatattacagtctcttagaggaaagaaactttattttgaatttattttgcttcttttatgctgctgtggacatagtagatgcttgatcaatattgagagaagaaataattttactctagataattctacagtgtgttagaatttacttttgctgcaagataaagctttataaatgtaacatctattaagagagtaccatgtacccgactcagtgtcagatgcctcggagcaactttgtgattagtgatattgttctcatatcacagataaggaaaccgaggctcagagagcctatccagtaggactggagctgtagatctggtagtctctgtggtaagaaccaaagcctttgttccatgaggaaaccttcctaagtatcaatgctggaagcagagaggagcttcccctgaggctctctggtaaagtttgtttacaaactcacaaactctgagacttaatttggtttggatagagattgagcatttattaaatgcttattgtgtgctgggtatttaccaaataactgcacttatttttggactatcaggaattctgagcatcctaggtagcccactgataagatgagggaaatacacataaatagaccctaattgctgatgggatttggaacccatttggtgagtcacattcaattgacagagtgcccactggttcccttgtccatatgcgcacagagattgtgctattccctcatgctgtcactggtggtactgacgtgtggtgcgggatgggaaaacatggagaaattatgcgtgtttaattgcacagcagcaagcagaaaggaatgtgagtgccaaagactcccactgaagcagaaatctggtgtcgtgtgttgctgaacagctgcaggaaaatttgtctggacctttggaggcagagaggtgggtttgccatactttggttctgagtaactttgagggcaacgaggatttataggcagcagatatgtacatctagaagtttcactctggagctttcacctggtttctttgctaccctatcccttccagccaccaccagttcaagccatggctaggagcagagggagataggaaggcctcagccccagggccactaggttactccaggtttcatgtgtccacagccctgcttagggccaccaaaatgctcaggttcagctgggtgggctaaaccacctagaactgggttcaactctctcctctattcctacaagtatggccttatgcaagtcacttaatctcttcaggcccaagtttacttctatgtgtgaggagtcagaaggtgatgttgcgtggggcctggcccatatcttaagagatggatctatgtccataacaccctgaatgctcccaatctcatcaagagatgggatctgtaagctctataatgattcagttgaacaataaactatcatagtcgttactctgtattgcgggcctgacagaccctatgctaagccattcatcatctctttaatccttaaaggaaagattaaaaaaatcttgagttaggagaggaagagtgactcatggaaggtcacccagctagtaaataacagaaccatcatgagctccaagcagagccactctagagccaacgcttctaaccacaccacctgcctggcattagttccacttcacacatgaggaaactgaggtttaggaggcattattatcaggggcaggacttgggtttgcaacttctgtctcttttgtttaacttgctgtgtcactttggacaagttgctcaacctctctgagctttggtttcctgatttggaaaatgtcagagtccaaagcctctggcagcagtgagaagcagtatcctgtgggagatggtggaggggaggggctaggaatgtcccggagacagagaatgagaagacatgggtgtgactgtggcattatgaagtggaggcagatctggaacggagacttgccagagtgaatgtgcctggctcgcactgcctatttagcagccgtcctgtgagagcccagatgggccaggtgggcaggaatctggccaggctccacaggcacacccacaccgtgagctgctgttgccacctaggggacaggcagtgaccaggggcccaagtttggctgtggctgtggctcagcggctgcacattcccagtctcctgctggtttccggagcggagagggatggccacggcttgctccaggagtggggaggggagtaaggaaaagcagtgaggagtgctgcctctggtttgggagttataaataaatccatctggaagtgtttggggctgtgggagcctgaggtcggccctgcaattcaggccatgtggtgcatatttccattcacaccagaaccacccccgcagccccctaccgccccgccccagtcccaggggactgtctgctaggacctgtccgctccggcccaggagagctgggcgagaacctttcaggccccagttttcagcccccacccccaccttccgctcctggcagcccaacttcagcaagataatgtctgagaaagtgcttcaaaaagttttatgtgctatccaagtgttggttgaatgaatgaatgaattttcaattcagcatttagcttgtaagctccccttgctgggaaggggccccttggtagttatggaaggcgaggcattctggacttttagcctccatctcaggatcacgtttcccacccaccgagctaaggcaggctgagatacaaatgcatattgcccaagttttgttcatctttctatcctcagcaccaagggtagcgctcagtaggcattggttatatgaatgaatgagtatctatattaatttttttaaacaacttttgtagagacagaggtctctctttgttgcccaggctggtcttcaactcctggcctcaaggggtcctcccgccttggtttcccaaagtgcaggcattacaggcatgagccactgcacctagtccaatttgttaatttaagcagcacttattgcacatcctcatgtgcagtgcactctgctgcatgctgagatcacagtggagaacaacatagagtccctgcctcattgagctagtggtcactgtgtttcttggtgaaagtactattgttgcttggggtgagtcaattctttgcagggtgggattctgtgcattgcaggatgtttaacctcatgattccctgactctaaaggccagtagttccccggagtcattttgaacaaccagagatgcctctagacatttccaaatacttccaggggacaggagagtgcagccctggttgagggccactgtggaggaacttgacaatggggcgtgaagcaaggcaacctccaaggtgtgaatgtgttgagtcctctgagttcacttataaattggtggtttagaactggggaatcacgtttgctttatagagatgtaagatgattcatcagtggctggattaggcccagaagcccataatgtagctgagttacatggttctaccagactgggttagtgctgaggggcaggcatcgagatggcaatttcggacatgttgatgagatgattacttgaaaatgtccagaaagtaactagaatctgatcccaggggcaagtgagaggtcagctctcaagatataaatttgggataagcccacgttgaggtaggagttagacctgaggcccaggttccattaaggttatccagggagaaggtgttgggaaagttgcagaatgactccaggataagtccagaggtagagaaagtaggccccagtggtatctcttctctgcctcctcatttctgttcccatggttagcaccctgtttcaggacttcaatttgtgacaggaccactgcagcaatctccttactggcctcctttctgcttttggtctctctgcctgtccgaattttctttttaaaacatggctttcatcatgtcccttcccaacattcaacaagtccaaactgcttagccttgcattctcacccactgcgatccagcttcccaccaacctgacacatctttggtgagttggctccgcgttcccctttccaggttcatggtttatccgtctctcagaccttactgtgtggctacacagaaccccaaatacacactgccttcctctcctccatgctatctccacccctgggatgctctttgaccctctttccatttggaaaaatctcactcaggcatcaaggcccagtgcaagtctcctgcatttccccaacccctcagaggcaggcagatgccttcccacctctgtgcaccctcctctccagctctcgctctgttgcccaggctggagtgcagtggtgccatcacggcttactgcagccttaacctgctgggctcaaatgagcctcctgcctcagcctcccgaggagctgggaccacagatgtgccaccatgcctggctaattaattttgtagagaaaggttcttgctctgttgcccaggctggtcttgaactcctgacctcaagagatcttctcaccttggcctctcaaagtgctgggattacaggtatgagccactgctcctagccatccagtttttcgtatacaccatgggactgcaagtctctcccacaagactctgagggcagtgaccatgactcgttttgctctgcaattccattgcccagcccagtgtgaatggacaagaaagtggggctgaggatgggctggtatggcagggcaaagaggaagtggaatggtctctttcaaacctcaccatggatctacttgagccacttttacctgctctctccctacaagtactgtctttggatgagggtttgtggaagagctaggaaagagaaggagccaaggcaagggacaggcagagggagcagcgtggagaagagaggagatgctgagaggatgaaagagaaagaaagtgggggagagcaaacgtctgcattggtggttcacatacataaaggattcaggtatggtagagtggaataagaaaacatttgggattctgaaaataaaatcagctgctttggcaggtcagctgaatgtacagttaattaataggcattagtgccctttggtgctaagctgtgcatggaaccatgtcctgctgggatcaaatggcagctacccggggatgcccttttaataaagagcagaaagcagcactgccatgtaagagctgcagaatccctcagagagttcttcttaagggcaccagggaccactggaaccccagagttgccccacatcactggcctggctcttgccaaagaaaggtgggcatgagaagagaactaacacatactgagcagctagtatcccaggggctatgccagacacacaaaagctcatttgatctttactgcaactctgtgaggtagcaattagccctgttttacagattagaaaatcaaggtcctaaggagggttaagaatcttgcccaagggcacaccgcttgaaagtcttggatcccagattccaatgaaggtcatcctctccccttgatgagcgggccaggacccagaggttggcagcagtttgctctccattctggctgactttggctgtggggctgatctctttggattgatttctttgaacataaacaaaataccatcagtttttcctggctttggaatgagccctcagaatcatgtgcttttctccagtttccagctgggtgcctttgctgggggagttcgtgaatatgaagcaacaggtctcattctgagaatcaacactgtgcaccaaaaaataccagggtacttttgctcccaggaggtatttcaagctggaggctttcagcctatggggccaagttttccattttttcttccctttcaatgacctgcatatgattgacagttgcctgttttcccaggaaaattataaaatctttatcaaaatattggcacctttgagttgttgcccacactctgttctgactgactgtgtgacccacgtccctatctgctcagtggttggacgtgttctgtctgctgtcaacctgtgagtcggtgagtagaggacaggaggtatggacaggacaggctgcggacagtgttttccaaaattctgatgtgacatgtttaagccaattcgtggaggagccaatggaggtagagtggctggagccaataaggggtttagagcaggggacaaaatggcacccagcaccaccccatggagatgcggctttggggtggggtaagttggctagaaaaccgatgatgatcgttttctggagttgttctggagtcaggaacagtctagaaaccctttgaattgaaccttggcacagagttgtatgtcccacacatgtgatagggtattaggattatcatgctgcatgcaagaccttctgaaatcttgctgcataacagaactttcagtcatacataatgacatgctgaggaataagttgctcgtcttgagtttggccttttgccctggtcattgtagtggaacaggatttttcttcaccaccttcaaaatcgattcagaatctggctacttcctgccacctccactgctatcaccctagtccatgccaccatcgtctctggcctggattattttagtatccctgtcaccagtctcccaaagtgatgctgtgaaaacatagtgtgagcatgtcagtatctgctcaacatcctccacttgctccccatctcactcagattcaaagtcaaaatctttatagtagtccacaaggtcctgcataatctggtcccccttacctccttgacatgatctcctacaaatcccatcgtctgcctctccattccagccacactagcctcctgatcattctttaagttttccaggtacattgtatttgcttttccttctgcctggaatgcttttccccagtatatcaggaaggatccctggagggagtgctcacaggaactgggaaacggttgctgtgtggagagaaccacctgacgggagctatggcctttggcagagggatgccgccaactcatggtgaccctgaacagagagagtggatgactaaataccccaatctcacttttcctttttcttctggtttctttgcaggtgcttcccattggtcaaacctaacccgaagccagagggcaagggagcctgttgatgccatccacacaggtcagcctaccagggtacaagctgtgtggagaagggtggaaaagatgtggacagacaaatggaaaatgtccagaacaactggatatctttgtagttggctccctcacttccttcacatctccactggaatgtttgttaccttttcagtatgtttcagtttgttaccttctcagtttgttaccttctctggccaccatttctaaaatttcaagccccagccctcaacacctcatatcctccatccatgctgtttgttcttcctagcacttaatactatctgacatgtactttatttatttcccttgcctatcgttggctctcccactagaatgagagctccatgagggcagggactttgttctgttcactgctatagtcagtgcctaggacaggacctggcacagagtaggtgtccaataaattgtgaatggataaatgattcacaatggataaatgatgtactctctggggccactctagtgagtctgctctcagccaggcacagctggatgtaggttaccagttgttactcattcctgctgttcacagtttcctctaaagaggctcaactgctgccatgttttcaggtcagcgggtggcaaggcctttgctgcctccggtattgaaacttgcacaacagtttgttgacttgaatcttatggaaattgttgctgcattaattggcatggactgagctttgtgtattatttaagttgtcatcagccacagtgggtagattcatagtcataggggcactggttcttccaggtggttcttccatacctcaaaggtagccttgattgctagtgggcctatttccaaattaggaggctcagtagccacttccttgaggctcacgggcaggggacctgtgaactgggtcctatgaccacagtgttggtgacacagggataggtgaaatcaggataagcaaaacagatatgcatttctagaacaatgtagttgtgtccaggctgatgtttttattatacaaataacataggaataatattcttgttgtgaaaaaaaatcaattcagctacaattcaaatctctatctctccggtcccactctgctccccgaaggtaaccactgttatcagtggagagtgcccactttcttccaaatctctttctgtgcatacacagtttggttttatgtgggtacttaaaaataaatggtgtcacaccatatatactaatctgctttttttcacttaggaatatgtcttggaaacctttctgttttaggagacatatggatctagttcattcttgttttcttaattaaacttttaattgtgattaaattatggattcacatgcagtataagaaataatacagagaggtcccatgtacccttcacccagttttcctcaataatcacttcttgcaaaactatagtacaatatacaagcagggtgttgcctttatacagtcaagatacagaatatttccatcaccacaaggatacttcaagtcatcctatcatagccacgcctatttccctcccaccctaacctcctacttaacccctagcgaccactcatctattctccatttctaaaatacagttgtttcaaccaggttatgtagtaaaatagaatcacacagtatgcaaactttagggattttgttttcagtcagcataattttctggagatccatccaggttgttgcgtgtatcaatagtctgcccctaccccttttccaataatctgctcctttttattgccgagtagtcttccatggcatggatgtatcaaagaccgtttatccattcacccactgaagggcatgtgggttattcccagttttgggctcttataaataatgctgctataaaccttcacgtaacaggtttttatgtggaaataagttttcatttctctgggataaatgcccaagagtacaattgctgagtcatatggtaattgcatgtttagtttaaaaaacaaaaaacaaaaaactgacggccaggtgcggtggctcacacctgtaatcccagcactttgggaggccaaggtgggcggatcacgaggtcaggagatcaagaccatcgtggccaacacggtgaaaccccatctctactaaaaatacaaagattagccaggcgtggtggtgcgcacctgtagtcccagctacttgggaggctgaggcaggagaattgcttcaacctgggaggtggaggttgcagtgagctgagatcttgccactgcactccagcctggatgacagagcgagactccatctcaaaaaaaaaacaaaactggcaaactgttttccagagcggctgtaccattttacattcccaccagcaatgtatgaggattccagtttcttggcatcctcatcatcatttggtgttctcactgttttcccttttagccgttcttctctaggtgtgaagtaatatctcattctggtttcaattctcattcccctaagattagtgatgttgaacattgtttcatgagcttctttgccatctgtatatcttcttcagtgacttgtctatttatgtctttagcccattttctggttgagttgtttgaatttttaactgtcgagttttgacagttctttatacattttagataccagtcctttgtcagacatatggtttgcaaacattttctcttggtctgaagctttttctcatcctcttaacaaggactccatagaacaaaacttgctaattttgatgaagtccaatttatcaattttgtttttttggatgtgttttggttttcaagtataaggtctggcttatatggctagctttagattccaaacactttcctgtttcttcctaaaaattttataattttacatttaagtttctgatccattttgttgattttttttttgtataaggtgtgagatagattatatcatttcctgaggctgccgtaacaagtaactgtaaacttggtagctttaaacaacagaatgtattctctcatgattgtggaggccagaagtctgagcttaaggtgtgggcagggttgcactccctctggaggctctaggagaggatccttccttgtctagtcccgcttctgcgggctgccaatactccttggcttatggccatgtcactgcaatctctacctccatcttcacatcatcatctcctctgtgtgtccgtcttataaggatacgtgtcattagatttaggactcacttgaatccagaatgatctcctcatcttaattatacttgcaaaagctcatcttccaaataaggtaacatccctaggctccgggaatcaggacgtagacgtatcttttgggagggcaccattcagcccactacacaggtcaaagttcattttttggtctatgtccagttgctccagcaccattcaaaaaggctatctttcttccattgaattgcttttgtacctttgttgaaaatcagtggggcatatttgtgtgggtctatttctaggttctctactctgtttcattgatctgtgtgtctgtccctccaccaatactacatagtcttgattattgtagctacataataagtcctgaaattggatagagtgattcctcccactttattctcccttttcaaaattgttttggctattctagtttctttgcctttccatataaattttggaataaacttgtctatgtttaaaatatcctcctggaattttgatagagattgagctaaaactatacataaatttggggagaactaacatctttactatgttaagtcttctgatccatgaatgtggcatatttctttctctatttaggtcttctttgatttctgtcatcagcattttgtagttttcagcatataagcgctatacatatcttgttacatttacacttaagtattttgttcttgagcaagtgtaaatggcactgtatttttaatttcagcatccatgtgttcattgctagtatatagaaatacaatttatttttgcaagcttatcttgtatcctgcaaccttgctaagctcacttattagttctaggaattgtcttgtagattccttgggattttctatgtagactataatgccgtctccaaataggagcagttttatttattcttttataatctacatgttttatcttttcttttttcttctttttttttttttgccttattacactggttagaacttccaacactatgttgaattaaggtggtgagagcagagatccttgccttgtttccaatctgagggggaaagcatttagtctttcaagcattgtgtttaatgttaggtataagtctaatattgcttgatccagaaaaaaatatatatatatttggtgtaagttgtatgtagatgctcaagttaaggaagttccctttttgccctatttctcagagttttttttaacttataataagtgttagattttatcaaatgctttttctgcattgattaatatgatcatgtgatttctattagtttgttacactgattgtgtagaattagcatacaattctttaaacatttggtagaattctccagtgaaaccatctggacctggagattttaaagggagtagttttaaaattatgaatttcatgtttttaatagttatagggctattcaaatcatctatttcatatttggtagatttgggaagtttatatttttcaagaaattggtctgtttcatcaaagttgtcaaagcatgtagcattgttcatagtattcccttattacccatttgatgtctgaaggctctgtagtgatattcatttccttcctgatatgagcaatttgtatgtcttgctagaggtttgtcaatcttactgatcttttcaaagaagcagctctttatttcattgattttctctatttttctattttcaattctgcttatttatgctgttatttttattattttcttccttctgtttgctttggctttattttgctctccttgttctagttacttgaggtaggaacttagatgattgatttgagaccttttttcttttatagtataagcatttggagctataaacttctttttaagcattgctttagttgcatctcataaatttttctatgttgtattttcattttgattcagttcaatgtatttttaaaatttatcttgaaatttaaattttcatatttgacccatgggttattttaaagtgtgttgtttatttttcaagttttagatattttcttatctttctgttattgatttccaatttggtcacagaatacatttcatttgatttcaattattttaaatttgttgacatttgttttatgacacaggatatgtctaacatgttttgtattccatgggcacttgaaaaggatgtgtactcttctgctgttggatgagatgttctataaatgtcaaatcaaatcctgttgtttgagggtgttgttgagttcctatatacccttgctgattttctatctagtaggtctatcccagatgcctgctcagccttctctgacttcaccccagtggggaaatttggggcacctggttatagcttagcaagggtgaaaagctatgttttcaacccctcctttgctggtggggttgggaacgggaccacatatttttttctgtggtatttggctaaagaattagtgtataaaaatttctgtcttggtaagagagcatgatttttaaaaaatctgcccctgttggtattttcagtttgcagactttttcagcttcaactctgggatatatgaggcaaaacaaaaatccagggaactcaccacatgccgttccttgagtcctgaggtctcttgcaggtgtacattcttctctccacctcctctccagtctttttgtgttcattttatatataatgctcacggttttttgttgtgctttagagggaggaccagggaaaagtatgtcattccatcttcccagaagcagaagtcctaacttattcttttaaaatgttatgtaactttgcagagtatgacttttatcaggatttatttaactattcacccattgatgaacttttaggttgtttcttaattgtggtggctaacacaatctttcaataaacatccattcaataaacatttgtgtacacgtgcaggagtttcttcatgatagatgctaagtggcgttgctgggtaataggggatgcacattttccatgttaatgggtgttgtccaatttctacccataatggctgtgctccacccagcagtgtatgagagtagcagttttgctcaacttcttgacaacacttgataatagtcagactttgagttccgaatgtaatgagtgaaagatgatatctggtggttgttatcatttgcctttccttgattcccagaggctgaatatcttttcaaatgtctgttggccatctgtaactctccttttgaattacctgtccatatactttgcccatatttattttgagttgtttacctttttattgatttacagaaattctctatatatttttattgttctttgtctaatacatacatttcaaatatatttccccagtttattatttgtcttttaactttattgatggtgtcttttgcctaaaaaaaaattattcttttgtgtagattcaaatttgtcaaccactccctcctggcttttgggttgtgtttgtgtgttgtttaaaatgactttctccataccaaagtcacaaatatataaatctctatttttcccattacaggtttctattcttttttatatttagttgtttgagctatgtggaatatgtgtgtgtatagtatgaggtagggatctcatttaatttttatcaaatggaaagctagttacttcagcactattcgttgaatagtccattctttcaccactgacttataaatgcagcttttattattttatttaacacctttacatgagttggcttgagagctctctgttctctttcactcatttgtctacttctgtgccaatgccacaccctgttaattactgtagatttgataccttgtataatgtcatccttcatttgttcttttccccaaaaaaattgttttggctcttcttatacatattctttttcacatggattttagaatcagtttgtcaggttctgtgaaaaattcctctggagatttgattgaaatagcaatgagattatagattaatttagggagacatcttttctccttttctccacacaactttttctccttcagaaagaccactggggcctgcacgaaagatgttcaggggtcaaagaacccacataacccatccccaacacacacacacacaaacacacacacagagacacacacatttgtgtctgtgtatttgtgaggacctacacttcaggctctgagggtaaatatttattataaacagaggctctggacacttgctctgctgttcagtggtacttccaaagtaggggcaactcttccttttcctgatcacaaacaaaccaacccaccaaaactctggcttgattacataccttgttgaacttcacagaagggagtgaagagtggaccaagtagagaagcagcatatggtaacattaggagccagtggggctgtgctgttttatccaggagagcccagggtgacagcaagttatcatgaatggtggaggatgggaagtaccagaaattaggagtggcccctgttccatgctggtgtctgtgggttggggtcctgtggaactaggaaacaacccaccccagaagggtgcactcattcatcatgcccctctatataggggaagacgggctgggtagcagggcctattgggcctgaatgttctggatagaccaaattgtgggttcagaggaagttctagctacctttgggtccactgctgacataatactctccagttctgtggagattttgtctttgtggggtgctgacacctggatacattacccttctacaatacagccatgctacctgcccagtggtgtgtcccttcaatgttgccagctggcagcaggtgctcgcagccagctgcacaggtgttgatgcctggcctcaaggtgggactgccagagcagctcaagcttcccactcaggtgctccagcaaattgtaggcccagaaagacattcagtagcgtgaggcagccttggagttaagctggagccctccagacttttcccaaggaggaagtaggggctggcttaggggttctgtggtatgtgcagatgctgtctgggcaagcagcactgccctcacctgtgttccagctaacaggatggacactgcacccagatatctgcgttctccccctacaaggtcatggtcctcaaggcaggaatggggtctgagccaccagcactactctatggacctaactgtctaacaaagctggcaaaatattactcagatagaaggcagaatcaattgtagtagatacctgagtagaagtacaaagtgatgtatggattttaattgccccactttttgaaatccgatctatcactaagtccttcccattcccagatctgtaatctttttttttcccctcattttcctgactctaatttagaccctgctgagcctgctggggtctcaggtgctactcctccaatctgttttcctttggtgcagctttcgaactcacagctctgatcactgccctctgccctatataatctaaaacatatttacagaatcaagcccaatgcttacctgactttcttcttaaatgccatttatagcttttcttttctttctaaaatggtaaatgtttattatggtgcttgactttcaaggacctctatgaggtggtccaacctacccttcctttgcttgtgtgggggtgaggacctgggaggttagggggaccatgcagcttgatgctatggaaagcacacctcgagctctggaatcagaggttactggttaatctaggccctcccctgcttcttatctgcttgaccccggccctcgcctcaccgttcccccgcccagtttccctcttgttaaggtggtgtgataaaaacgacccctatcccgggttagaggtgaaaactcaacgcgacaagtggaggagagcgggcttttagcgccagaagcttccatgatgcccaggtccgcgggcagggcgagggcacgggccggggaagcaagcgttgccgcgccgctaccgtcgggggccggcccccgggctgcttttcgtgcgcggagcagctcggccagtcaccaggcgcgtgcggaggcggcgagcctgcgagggcggccggtgcgggcgcagccggcgcgatgagtcaccatccctcagcacctccggaacacgaggctgcttggaagcagccgggcccccgcccgccctcctcccccgccccgcggagtggcggcgccagcccgatgcccggcagagggcgctgcagtgcggctgcggggccaccggcccgcgctgctctggctgccaaaggccggcgctgcctttggctcagagggaaagatcggggcccagggatggggtgcgtgaggaatgaatgtttctgcagtgccagaggtggctctgtttttgatccagaaacgaaatggacttcaagattcagacactgggcagagtgatggggccgacacggcccctactggagagtgtccagtcttgatcgccccaagcttttgagcagggatgtcctgtccgaggctggtgtcgtccccactctcgccagagaggatctgtgataggatgagtctcgcctttccaaaatgaatctgcctaaggacccagtccttgatctcctctgtgacctctttcacctgaggtgatggaggttacgaagattggagctgtctgcagtggagcgcaggagaaagtgcacaagctttcgggtgaccagggtttcagtgccagctccatcatgagattgctgtgtgaccttggtcatttcattattcattcattcattcagaaaacactcactgtgtcacaaggcactcacggtgaagggaagagaaggaggccaagcctgtggagacaattgccctgaccataaaatagcttaggccaggtacagaaacccgacacgtaggtaaacactggctgaatgaacaaatgcgatgatttagtcaccacacactagggcagagatttttggtcacttatgctcccgagtacatggaacagtgcctgacacacagtgggtgctcagtaatttgtcgaatgaatgacagaggaatgtactgagtgttctgtgagcacagcagaggccacctaactcacaagattctgtgctgtttgaaccgagtcttgaaggaagggttgggattagttaggcagacaagggccagatggagggtgatacaggcagagaacagcctgtgcaaaagctaggagtcctcagagttctcacctctctgagcctcagtccctcctgtgagaaggaaaggatagggctggctctgtaatttctcagatttttctagatctaaggttctcagattcaacaaatgaatccagttaccctagtcagagcctgaccagtgctgggcagtccaagagactcaggttttgacttttgactcagcccatctgcagaataaaggcctggtgatctcaggcaccccttctccatctgcttcctctgtctttcaccttagaaatctcccctgaatcctatccccataggataaactatctgcagcacaaaagtcagcacttacttgtattctgccatgatttttcttcgtgttattttttgaaatagtctttatttacagatttttacactaacacaggctaattgtgaaaaaacaggaaagtacaaagaagaacataaaaactctccgtaatttcactacctggcatagttccttgatttttttatgccttcattaaaatacacacacacacacatacttcagctcacacagcagcactgacacagatcgctgtgagtcttgtgttcccagcaaaagcatgagctggggacagttctctctttctctccattagtttgtctctgatgggaagagatgttggctgggaccccaaaactctgactctttaaccagctgcagatcatcaggctaaatcctcaaagaacatactgctcagaggacgtttcagtctgaggcagggctctggacgcaaaccactatatggcctcttcttccttcctggagttgggctagggttaagctagattatgtgggggccactagccctgctttggtccagaccagagacagtgctgagcagctttctagggaggggggaagggagtgctctgggatttactgccccacctgtctgagagaagcccccaaaataaacccataaccctagctgacttggtttcccttggcccctgccgttttaaagctccatccccaacacagtggctccttttttgccctggttccttgcttttcaatgtgtaacccatggaccagtgacatagaaaacaagatctctagatgatggtttgtatgttgactctgagaagcaaagtgcagattctgtttcagaaggtctggagaagaacctgaaattcttcattttgtaacaaactctcaggtaatggtgacatagctggtccacagaccacactttgagtagcaaagatctagattcctcttttgaccttgtcttctctgaaagtgaaagggcaggggaaactccctagaggtgagggtgtgtacacacacacacgcgtgcgcatacacacacacacacacacacacacacacaaatattgaggactatgttctgggtgttcagtgaatgcttgccctgttaatgcagaaagctgaggagtgagaagacttaaagctgtgttcccacctctccaatcacttattcatttcagtgatgatagcatcagtttctcagtcaccaaatggaattggttccttagacatttttgccctggctctgcctctattttcttattgcttctattctcagacacttctcatctatcccctgccttcctgtctgtggtccctttccctccagttcactgcctgtcacccaattcttgttacccaaatccaacttaaaatcactggacgtgtgtgcttcaagggagagtaagtgggcagagaaagggagcttctcctcagggcccaggtaggccttcaaacttcccttactctgaatctatactggggtagcattattattccctaggaaactgaggctcagagacattgagtaacttgtccaaggtcacacagtgaggaagtcagaattgagatacgaatccacatctctttagttttaaagcctgggctctccacgatatcatcccttcatcttactcagggggaagatgaagattgggtgacttaaggtcattcagggagtcagggatgggactgaggctggaaactcccttcttctgacactgtaagtaaattttcattcggtagctcctctgctcagaagccttcagagaaaccctcttgcctatagaattgaaacttctgagcctgacagccaaggctgtcatggtgcccctgcctcagctcggcttctccttcttccccagcactttacttggcatgtggaggtgctagaccatctctcttttcctcacctaccagtggggttcttccctgaatcctgttcctccctagcctcagtcatgccttagaattcctctaccatggtgcctctgctctctgggatattttctcgacctcaaacacccaggcactctacctgcttctcagaatctttcccatgcttcaagagcataggttctcacccctctgggaagccccccacccaccaaagctgccctgagcccttagagccttgagctaggagcctgtcactttagcagtgctgccgcctgttggtggtttgaagagctccaccccaactcacagatgaggccaataaatattattatactataataagcctctgcagctataccccatggcttgaagaactatttccagaatctttcttctccattctgaacttgctttcattactttaatgtctcaacccatttgggctgctgtaacaagataccatggacatgtggcttaaacaacaattttttttttcttacagttctggaagctgggagttttaagatcactgcacccatagatccggtgtctggtgagggtcctcttccaggtttgcagatggcccccttctccttgtgtcctcacttggcagagaacagagagaggaagcaagctctctgatgtttctttttgtaagggcactaatcccatcatgagggatccaccctcaagaactaatcacctcccaaaggccccatctccccgtaccatctcactggggagtagggtttcaacatatgaagaagggtgcacagacattcaatccatgacacttagtgtgtctaggtcctagagaccgtatctggttttcacaactttcccagccctgttagagtctgaggcttaacttaatccccactttttgatcctagatgctgcttcagatcaccccacctccatgacttacctattataccttgcacccaacagctctttgcattccagcctggatacagtaccccaggtccctgcttggcctgaaaggaaagtcaaacatggctgcctggttatccattcactatttctactactttctagatcttgtcttcataagtaaactctaagctcctggaaggcaggactgtctgtgtcttattcttttctttatcctttgcaataccagcattttcttttattcattcatttatttcttaaagactgaatgttcattctctgccaggcttgatactaggtgttggggcagcagaggggagacaaatatggtctaatatattctagtaaattcaaggcaacagggaagtccaatgacataagattggcaaattgactttgggcccaggccagtagaaatacgtgtgaaaatggttggggaacaggcagggcctgcctatgcctagaacagataaggaagaaaatcaggctggcggatgctggaggcctgcttcaagaaccttggggagaaatgggagaaggagatggagtattgtctgctttttccaaaatgagtgcctagaaagggaagtggcaattatggtcctgatgaaaacaatatttccagttgttacctgaaacaataggatctgggggtgtgattctcagaggtgggtgatgtaatgggaatagcactaaactaagctttctagccctcaaattccatgaccctttgacctgagttttggtttcagctctacctcttgttcactatcagacttggctagctccattcccctggctcagcctcagtttcctcctctatgacatggcaggatgtggagtggggtggtgagtgaggagcttggactcagggactgcaagcttcctctgagctcttgacattcttggcatgcaacaggaagagaagcatggattaggaaggttctattggaggttgagactggaggcagggaggctggtggggaggccgaggcagcagtgccagtaggagtagagtgggagagggcctgagccaaggcaggagctgacagattggtgacatatttaggaggaaatggaaccgacgggaactgtcaactgatgagatggtgaggatgaaggaggaggaaccaaagaggatggagatttgactgtgccctaggaggcctgagggagaggaatcttgggtcccaggcctaacactgccaacaagcttccatgtgaccttagggtctctttctgtttcagttgccacatctgcacagtaaagagatggctctgatgctccctaaacccctccctgacccctaacaactataacaaattagggagcgctgtgggtttccaaatcagtctttaatttgttagaagtttgtaggaaaattctgaactcttacacaggaagctgagatctatggtagggcttgtaactataatggtttggtggtgaggtaaggacagcgactgaggctacaaatggggctaccaggagaggccctggggacttctcctcaggtgaagcccaagagttggcagtccttgaaacacgggcttacttcttgacctaggaagatgtggccttggcagtattttaaaggagacatttgaagatcccagatcccaaaagaatacaaatggcacagtactctgcatggtgtttgagccatttttgctggttcattaactcatttcatcctcacaggtaccttcatttcacagatgaggacgggcacagagaggctgagtgggtggtctagatcacatagctaaagaacaaaagagcacacaaagctgtttctggggcagtaagccacagtgctattagcagcatctgtgactgtcactactagaatcacagctattttcatatcacattacggttgtggcagggatctcagaaaatcatctatgctcatcaccacttcaaaatgataatagtcattagacccactgcttgatcgtgttatattgaaggtgttaatcaagaagcacatatgactatattgtaaattgcatctcaagatacagtaatcagtttcctttataatcctaggtaatttatctaatacatttagaagcattttttgaaatatgcaatacattgttattaactatagttgcctatgttgtgcaataggacaccaaaactttttcctcctctctaactgtaacttagtgcctattgaccaatgtcttagattttaaatattctcacacataataaatgtgtgataaatgatcataatgatacctatttgaggtcatggatatactaatttccctgatttgaccattccacaatgtatacatgtatcaaaacctcacaatgtaccctataaatatatacaattatttgtcaatgaaaaataaaataaaactttaaaaacacaaaataatagctactattttctacccccaaagatctcccacctatttttttcctagaaagggtccctaagccgtgccagactgccaaaggcatgacaaaggggtccacgccatggcctagaaggcactcctgatagagggtgggctggaggcttggccaggctctgtaccaggcacctcacctatgcactctcacctcaccctcccaactccaggaactcggtgtgattatcccacttgacacacaggagaccagcgctagacaggagggaagccttgtctacagtcaccagcatgtaagtgcggagctgggacacacatccaggtctgtccgaccagagtccattttgtaaccactgcagctctctgtctcctctggaaggtgactgccagcccttaaatggagttccctcaaaaacaaatgacccatttagggcaaaggacacctgagtggaaactaagtgacaccatttttttcagccccagtgcacatttccagacctggggtgtggaatgagggctcttccaggtatgaagggaacgtcttagagcagtactcggtttgatgcttggcagccagggcatagtggttgatggccagctgcatgcctgagttcaaatcccagctatgccacttgctgtttgtgtactcttggacccattgcttaacctcttgatgcctcagtttcctcaatgtaaaatgaagttactgataatatctcctaaggtggtcctgaggattcagtgaagtaatacacataaagcacttggcactgtgccttgagctgtggtgtgaaccagtgccattattttctcctaagagagtaatgcatgaaggagactcagggctcctggaagacctttgacgtctattaaccctttgtcccttccccgtctgttatcagggtctcccctgcccgattccctgatgtatagacagcaggaacctttaaatccaatgttcccatctgtggctgcacattaatatcacctggggagcttttgaaatggcgctgcccaggcctcatcccagactattggaatctgactctagggatggggatggagttggagtattttttctgcagctcctcaggagattctaaagtggagacaaagctgagaaccatggcctcagaaggaaaagggcctgtgtgctgctctttggggacaacaaggaaggaagaagaaactcagagatcatgccctgctctgcagacaggatgaaaaagaacagaagcccaggcatggggaggaggtgggcagctttaagctttaggaaacagtgggagctggagcctgcagcaagaaagagctatggggaaggcaccacagccagaggctgtcccaggccctgccaggccaatggcctaggtggttttcctgcagaaggaaatgggaaatatggaggtgagggcgagataaggttgtaaggatgtactcacagcctctttctgcaccctcaaatggcagatcctgataagttgttaacaccttgtaagaaacacgagagacagtctgttccacctcctcccctggcacacatacaaaatgactccccatctacccactcataagatcacatccggattccaccatcacccaacccagcagaaagtcccacctctggtctctgtaaatatctgccagccagagcagtacagcatgccagggtcagacaccagttccccaagtgtgctaccttttgttataagaggagacttcagcaacttgggagctgggcagggctgcagtgatgatcttttcaatgtgtgaagaagggaaactgtgtttgagaggagaagaggaaagtggttggcctatggtgccacagggagtagcagaagagacaggattccctgtccagtgctcccttccctacacaccctgagacttcagctttggtccctaatctgccagtgccaggaaactggcccacttcccactacagccctgtggctctgacagggtctctcatgatatccagcagagatcttgagtcagctgctctgaaggaacttccagtaaggctccagcttggagtctggatcaggagttggggcatggggcattttgagtttcgtgcttatgttgccttccccccatcttttgctcctggacatcttttggctaggtggggttttcctcactccccacctccaaagcggagactatgtctttaagaaaggacgagtcagagccgcggggatcagtttcaagcagccctcagaaggcgaatctggattgagtttaggaagaaaaaagaaggggttagctttggtcctgcctcctttcctttctctcatttgctcgtctctcctccgtccttcgtctggaaatttggtgaacttggccaggaggttccagagcccagggctttccccagcagcctcgtcctctcacctggtccctccttcagctcctgagcacacagtttggaggacagctggacaagtggctggaatgagtaggtacgtggtctggacattttaaccttcaccctgtcagggaagtctggggagtgtccaacacagaccctgtgggaggcggaagggaactctcaagacctccgagaaccttggtaaccgaggcaggaaggagatgggtgggctttggtgactccactaggggttttgtattaagggtcagaaggaggcttggtccatgcagcctggcctacctccaccctcgtgagttgcctaccaaacccatgatgggtgggagtttaggagtgtgaggtgttgagtttgctgctgctgctgctgccgctgctgctgctgctgccactgctgctgctagaggaatggaggccagagggtgctaggaaccctatgagaaaagcagatggcaacatgtccagccccagccatctgtgactctggtggcatggaaccactcagctaaggtgaatgggattcagtctgctccagctgcatgtgcagtgggccaggagccactcaaggtcttcttgggcttacttttttcaactttgttggatgactacaagcaaggcttttagcttttaaggacttcagtttacacttcagggaaaatgacttaatgctactcagctgaaagggggaagcacaaaggaagaggtagagaaggcaaactgggtttgtgatagagattcaaggagagctcgagatttctgtgagctcaaggatgttttcccctattattttaggaataattcattcatttatttgtgtatttaatcagcaagcatcagttaaatgcctattggtgcccgtcactggtgtcagggaaccagcaatccaatatggcagcaggtccttccgcctggcctccttccccagatctctactcctccctttccctcacccctcagctgatttgagagaggaaggggcactagcttctagtgtactgaggtgacatgataaggtcatgataggtgctgacattgttggcactagagtgggtacatctcatttgacaacactctctcttgaaagagatttgggcctgggtcccaaacattacctcagccactgggaaggattttgaaggtcaggaaacaacagggatccacaagttcagcctaacccctccctgacagaaggggtggcccaggccttctttggacattgtcggtagagctgggcccctggttgggtcctcagcatcatatgtggaccaagcgttgtttggatttgccaagaacatctaaggactttggtctttgtgatttaagtaagttgtcataacttgggcaggaggcatgctgggatctcagccacctggctgttggggaagggatagggttgggaatactggctcttgggtggtcctttgggtgtggaaagcttaggcatggcatagacaagcatgtatgtgtgtatgatataggaagtatcccccaggagaaaaggcccggcaaaagcaaggcagagtctaaccctgtccaagtagggttggggttcaggactggagtcataactggcagctcacacaaggacctaatgcatacagaggaagggcagtgagaccaatgccagcgcctgtgtactctgctctcaccctgctcaagcagaaatgggagtggtggagccaatgggtgagcttcatgacttcagctgagagggctgaattggcctgctcggggctgccaccaccctacttaaaaacaaatcctcatagcccagctaccactgcactgggtgtttgcgactgaactgggcttatctaaagggttatttgtgagcctggaaaagggatagggaataggccatgatgtcctgaggctatgacagtagcactttgctaacttatccttgtccacccttccaatcccactgtggctgctcctgcctcctcaggaagggatacctccaagctcaactgcccactcctgcaggtaggcctactgccctcgcacatgctctgcccacttcttggattgctgggctctggctgcaagccctcagagctcctgtcattcctttgcagaacaaagcagctactccaagcaagtggtgcagaagggtggctggtggaggggaggcggagaaaatgtcaggggcttatgtcaggaaagttgaatgcttgccagcagctgggccttcccatctagggtgacttcatgaaagaagcccttgaaagattgttccctctcccttgtaagggtgcatttttgggaatcactttgttttcctctccattttctctgcaagtctgattgtttgaggagagctaaacgttatgtgtactattaaagaaaaaaaaagtggagaaaaccaccccttaaatgtaaagctgagtaatttcaggaaaggaatccaagggaatgaggtttctgcccaagtatgggaaaatatccatccatctccccacttaatcagaaaaatgatctgccgaataatgagtcatgctgcctgtcagcaaacagcactgaccctagccacagagccaggaataacagaggtgagagatgacagtagctatgacgaagaaaagacatgaagggaactggattcctgctgccagcagctgtttggctcacctttgccccgtcctgtgcaataaaaaatgcactggactgggctgtgttattggtgacactgatcaataccactggggttcatctgtgcattctgataagtggggtctccgcagggggcactcagaatcaatcacagctttgtgcacagtctgggagttcttttttactgaggaaagcatatatacagtaaattgcataaagcacactgtaaatgtacatttcaatgaagttgtatatgtatatgtgtgtgtgtgtgtgtgtatacatctgtgtgtaaccaccacccagatcaaaatatagaacattcgcagcaccccagaaggcttacttttgccccttccatttggtatttacacgcaccaagtgctgcaatcaaatgtttgtgatcagtggcatgctggtaaatgtttaacaaccagttctggtgtgtgtaatggggtgccctgctttgtagcttttgccaattttgtggtataaatattcctgctatggctaatttcgagctaccaacagtttaacaactggctcacaaaattatgaaaatttaacaattggctctggtgagccaagcagactggctccagcacatcaccagttgtaacaaaggattaaagagagccaagtccacccaactacccaatgcaggtaggagtgggctcccaaatactcccagttccagcccccttagtgaggagagaatcgttcataggatttaaagtgatctccagcttcttttatgcagcagacatcggttgtgtccctaccttgtggcaagctctaaggtcacgaacatgagtaaaccatggttctatccctcaaggagcttacataatttaacactcggaaggagaggcggacgtgtgaaggtatatgtgcaataaagagttctagggtctgtgtaggagactgcatggggcttaattgagggcaccaaggagggctcatttctgcctttgaatcagaaatacatctcttattccactttgctttgggaggtgtcttggggccgaggaaaagagcatcagactcctacacacctgttttggatcctggttccacctcttccatgctgtgtgatcttgggcaggtcacttaacctctctgagcctcaggtcccatatctatagaatgagagtaattgtagtacctaccttacacagctattgtgagtattaaatgagctatttcatgtgtagcacttagcacacataagcacttactaattattagctttaattaggaattattagcttcaattaagaattattaacaactagcttggacaagctttgaacctctctaggactcattttcatctgtgagatgggattaaagtgccaaccttgtcagtgttgtcatgagaattaaattagatcatgtatgtgaattgtctggcccagagctggttctcagcaaatgctggtttgcccctttcctgctttctcgctcctttccaacacactggcttaagacctcgcttggaaaaaaaaaaaaaaaaaaccagttctgacatgttaggaaataaatatatcaagtgaacacattaaccctttttaaaagctttttattttgcaattttagactcaagggaagttgcaaaaaaatttacaaggtggatctggtgaccctttactcagttttacaatgttgacatcttacacaactgggaaagtgatgttggtacaatccgcagagcgtattcaggtttcacgttttacatgtcatgtactctgtatatgagtgtgtatatcatttcaaacaattttatcacatgtatagatttgtataaccatcacaattgggatgcagaacttctagtaactggccactgaagtaaaaaaaaaaaaaaaaaataagccaggcgcggtggttcatgcctgtaatcccaacactttgggaggccaagttgggcggatcacctgaggtcaggagttcaagaccagcttggacaacatggcgaaaccccatctctacaaaaaaatataaaaattagctgggcgttgtggcagggacctgtaatcccagctattcgggaggctaaggcagggagaattgcttgaacccgggaggcggaggttgcagtgagctgagatcatgccactgcactccagcctgggcgaaagagcgagactcagtctcaaaatggtaataataataataaaaaggagatgcagaactgttgcatcaccacaaagatcttcctcatgctacctcttggtatttgtacccatctactacccactcccctcatcagctaacccctggtaagcaagaacctattcttcatctatatgacttttttaatttcaagaatgttatgtaggccgggcatggtggctcacacctgtaatcccagcactttgagagacaaaggtgggcagatcacttgaggtcaggagttcgagaccagcctggccaacatggtgaaacctcatctctactaaaaatacaaaaattatcctggcgtggtggtgctcacctgtagtcccagctcctcgggaggctgaggcaggagaattgcatgagccgtggtgtcagacgttgcagtgagctgagatcacaccactgcactccagcctgggcgacagagcaagactctgctcttaaaaataaataataaaattaatcaatcagttgggcatattttgtgggtctatttctggattatctgttatgttccatttatctgtttatctatctctccaccaataccacacagtgttgatgagtgtagctctatagtaggctttagcactgagtaattcctccaattattctcctttttcaagattgttttagctgttttagggcctagtgcctttccacgtaaattttagaatatagttgtctatatctataaaaagaaaaacgttgtgggattttaataggaattgtatgaagcctataaatcaatttgggaagaattgacttttttttttttttttttttgggagacaaagtctcggtctgtcaccaggctggagtgcagtggcgcaatcttggctcactgcaacctccgactcccgggttcaagtgattctcctccgtcagccttccaggtagctggggctacaggcgcacgccaccacgcccagctaatttttgtatttttagtagagatggggtttcaccatgttggccaggattgccttgctctcttgaccttgtgatccacccacctttgggtcccaaagtgctgggattacaggcgtgagccaccgtgcccggcctctgaattgacatctttactacgttgagtcttccaatccacgaacatagtatgtctgtcctttatttaggccttctttcatttatttcaccagcatttagtcatattcagcatagatatcctatacaagttttacacataagtgttttattttctttggaacaactttaaatggtattatgtgtttttaatttggttcccacctggttagtgctaatatatagaaatgcagtggtcttttctgtgttgatcttttatagtgcaaccttgctgaagtcatttattagttctaagagtttttgtgtagattgcttgggattttctatatatatataattatgtcgtctgcaaatagggacagttttattccttcctttccaatttgtatgccttttctttctttttctagcctattgcaccagctagagcttccagtattatgttgaataagaatggtgaaagtagacatccttgtcttcttcctaatttcaaggagaaaacagtcttccaccattaagtttaatgttagctgtagggttttgtttttgttttttgttttgttttgttctttaatagatgttctttaccacgttgaggaagttcccccactcttcctagttttccaagagtttctatcatgtatgggtgttggattttgccaaatgatttgctgaatccattgattggattatatggttattcttctttagcctgttgatgtagtagattacattgatttttcaaatattgggtaagccttgcattcttggaataaacctccactagagtaaaatacccacttggtcatggtgtataattctttttatatgttgctgaattctatttgctaatgtttttaaaacatttttgtgcctatattcatgaactatattggcctgtagtgtttttatttgtataccgtttttgtctagttaggtatcagggtataatacctcataaattaactgaggagtgttccccccttttctattttctgtaagagactgtgtaaaattggtgttaatttttctttaatgtttggtagaattctccagtgaaagcacctgggcctggacattcttttttggaagcttttaaaaattgtaaattcagtttttgaaatcactataagatttcacattcagattatttatttcttgattgaactttggtagtttgtggttttgtgatattggtctatttcttctaagttgttgaatttatgagtgtaaagttgtttataatatccttttaaaggcttcagaatctgtactgataaccctgtttcattcctgacattggtgatttgtgtcttctctctttttatctttgttattcttactagacatttatcaattttatcaatttatttgaaaatgaacttttgtttcatggacttttctcgattgctttcttattttcaatttcattgatttctgctctctttatttcctttattcttcttactttgggtttatctttctcttcttattattatacattcttatagatatgaagcctttcttcttttctaatgtaaggatttggtgctataaattttcctgtcagcattgctttaaatgcatcccacaaattttgatatttgtattttaattaattttcatccagtccaatatatttttaaaatttcctttgagtctttctctttgattcatgggttgtttagaagtgtgttgtttaatttccaggtgtttggagattttccttttatattttaaaaattgacttgtagtttgattctctatgtcaagagaacagactcagtgtgacttcaaatatttttaagtttattgagatttttgccttggtgaatgttccatgtgtattctgctctcgttgggtggagggttctttgtatatgtcagttacatctctcggattgattgtgttgttgaattcttcttctctttgatgattttctgtctagtatgtctatcaattactgtaagtggagtgttgaagaacccaactataattgtggattcatcaatttgtcctttcagctctctcagtttttgcttttttatttttattttttgacacggagtttcgctcttgttgcccgagtgaagtgcagaaactttatctacctttatgcccttttagcctcccttatttataattatcttaaatatttcctctacatacatttagaaccacataagatagtatttgcttcaaccatcaaatataacttagaaaattcaagtggaaaagaaaaaatctattgtatttacccatatttttgcttactgtgttatttcttccttcctggtattccaagattccttctttattgtttcatttatgtttacagcaggggtccccaacccccaggccatagatcgataccagtctgtggcctgtttggaaccgggcagcacagcaggaggtgagcggcagggcaaggaagtattaccacctgagctccgcctcctgtctgatcagtggggcattagattctcataggagcatggaccctactgtgaactgtgcatgcaagggatctaagctgcatgctccttatgagaacctaactaatgcctgataacctgaggtggaacagtttcatcccaaaaccatccccctgactcccatctgtggaaaaattgtcttccatgaaaccagtccctggtgacagaggatttcctttagccatgtttccagggtaggcctggtaacaaagtttcttaatttttccttctctgagaattttttgatttccccatcattcctgaaggatattttcactggatataggattctgggttgacaactcttttatttcaggatgtgaaaaatgtgtcatttttttctggcctccatggtttctgatgagaaatccactgtcagttgacttgcttttccactgtgagtaatcattatttctctctgactgctttcaaaagtttttatttatttttaataaagaaagtttaattatgacttgtcatgaatttcttcgggtttatcttacttggttttactcaacttcttgaacctggaggtttgtgtcttttgccaaatttgggaagtttttagcctttcattagtcaaataccttttcagtctcattttatttctcctctccttctgaggctctgatcatacaaatcttagatctttttttttctgtcccacagctctctaatgctttgctcatgttttcttttcagcctttttttctctcatgtttatatcatgtaatttctgttcctctatcttgaagttcactgatactttcctctgtcttattctttctgctgttgagcccatccactgagtttttaattctgttattttatttttcagttctataatttccagtgtgttctttttgatatcttctattactttggtgagctttcctatttttatttttttcaagagtatttgttgaagcactttatgatgaatggtttaaaacctttgcccaataattccaacatctgacatcttggtgttgatatatgttgactgtcttttctcattcatgttgtgattttcctggttcttgatatgatgagtgatttttaaatttttatcctggacattttggatattatgttaggaggctcttatttcagtctcctatttcagtaggcaggctgtttaggtttaacatgtaggatcggctgggcacagtggctcacgcctgtaatcccagcactttgggaggctgaggcaggcagatcacaaggtcaggaaatcaagaccatcctggctaacatggtgaaaccccgtctctactaaaaatacaaaaaaaaattagccaggccttggtggtgggcgcctgtagtcccagctacttgggaggctgaggcaggagaatggcatgaacccgggaggtggagcttgcagtgagccgagatggcgccactgcactccagcctgagcaacaaagtgagactctgtctcaaaaaaaaaagaaaaaaaaacatgtaggatctggcctacttttgtgggctgtggttccaatgacaatttagtttttggagtccttgcagtgctattctggtctcctttgtacatctggtgcagctgcagctccctaacttggtccctactgatgcttcacacaggggcagaatgtacttacccaggactgatgctggtaggtgggggtggaagataccaggcctgtgagggaagaaagctcttcccctggccaggtgcctgtgaaactgtcacttgatttctaccagtgcccccagtgttggcagaaggttctttcctaggcctctcactgagttcctctaggtaagggatgagagataccgtgttgcagggcagagggtgcctcacctggccaagtctctggatagcctggtgccaacagagctcccattctatctctgccagtgccaccagggaaagaaaggccaccttctgtcactgggtggagggctgggagacatcagatctgggttgccttctgccagtgagtggagggtcgagaaatgttgatcaaccccctttttaacacagaatccaaaataccaaaagctcaaagaatccctatttgtttcggcagcacaggactcatttccaggtgcaaggtatgagagtggggtctgggagtctgggacctagtcacatttcttgtctttggacaagtcactttgcttatctaggctcaagtgtctctcctcagcagaataagttgcaagtggcacctccttcccacggttgtgtaaaggtttaaatgagctgtggtctgagatgccgcaatccctatgcccgctgtgcaggcccttaacaaaggggtatgggtaaaaggttgaggcagggcagcctgaaacatcttcttctccacattttcaaaattacaaactctttcaactctttataaacagtcaattataaactctttcaaactctttataaacagtaaagtagggagaaaatgtcagatcttcacattttgccacatttgcttcagatcttttctaagaaacaggtcattatacatccagttgtgagctctgcccctaccctggcctagaggtagccagtgtcccaaactgtctgtttccaattcccatgcatgtatttatattttaccacatacatatacatctataaacagtatataatattgttttgcatgttttaagctgtatataaatggcatcatactgtgcatacatgttctgcaaatttctctttttatgcaaatttagagtgttatgattggtccaaaagaagactggccaagcaatagagattagacatgatattcatgtaaaggcatttgatatgagtagagagcagaaatgtgtgaataaagatatataataatataagagataaaataggacataatggtatatataggagataaagatatcaaggtatataacaacataggagataagactaagtaagagaaccaagaaagcagagagggtgattagctgtgagaaaaaaaacatacagaggccaagataccagtttgtagaagcagaagtggattggctgcccaaagaagcccttagttgaaggaccttttctcctctgctttcctttccttcccttcccttttccttcccttctcttttcttttcctttcctttcctttcctttcctttcctttcctttcctttcctttcctttcctttcctttcctttcctttcctttccttccttgtctctctttatttcaattaggaaagggaaagtgatcttgtgcaacacgactcttagggatagttgggaggattagagtagtctcaacctgaatttgcggcttgtgtctgaactttctctttttaacattatgcttttgagatttatccatgttgatacacgagttagagtttagtcattttaactgctgtacactattccatgtaatggctgtaccacaatttatttaaccattttccagttgttagacatttaggtttcctccagtttttccctgtttataaacaatgatgctatcaaatgcctcttgaagcatttgagaaagtctacaacttcaagttcagtcaagtgtagtggcgtacacttccaatcaataatcccgatgatgtggtgtctgtaggaaatcttggtaaggtccattaaccacaatctggcccattttggttggatgggagctcgttgcaccaggtcagctgcgtcctgtgtggagttgtgggtattgaggactcagccagagaccccatgatacgtttaggactcatgtgtgcatcttctttactcattctcaatcccttggcctcatctcatctcattgtggcctgttaaaagtcctttagtccctgtcactttcgtgtccacagtctgcagtacatgacatacccttggtgtccctccctctgccattcttcatttgttagcctgcagccctgtggccccaggaaaggggaagggcctaacatttattgagctctactctgtaccccaacaccaagttaagtgcttttagatacctcgtctcattaatggtcccagccacccttccaagtagttattatcatttccattatagagatgaggaaactgccaccaaaataggttcagcaagtgcaacattcatacctatgggatggggattggtgtgaggcagagttcagcttggggctacaggcagcctttgatcgaggaattgagtttatctctctctttggggttttgttgaccatcctgtaacaggagacactcctgttagggaatgtgccctaatgttcccttgacagggtaagcccaaggaatcagcgctggatgggaacacagatcatatccatgctttgggatcacagttccacatttcatttaccataccctcccactctctcacacacacatactctcttactaactcagactaacaaacggccctaacacttattaactgtgtgaaatatgtcacttgacctagaggtaccttgtttaatcctcattcacactctgtaatgaagtatcgtgatttccatttttttcaagtttggacattgaacctcagagaggttaagttacttgccctggatcccagagctaggatgtgctggaggccacattctaaacgagaatgatgtgggtggtccctggagcactccaaccacaaactgaagttcaagtgtcactctccatggtcagatgagcttcgttattttattccaggagcatcccctgagcacgtgcagtgtgccaggctctgtgccaagcactcagtgccaaatgagattgactccacagagctgtcactttggggaaattagaaatgctctgatgccacccaacttgcttctggccctcataaaagaaaagtgctttataactccctgttcatcccttgagtcagtcagtcattgtatcacttactcaacaagcattcgagtgttccctgtgtaaaggccctgcgctaggagctggagattcaaagatgaggaatgcccagtccctacccttgagaaacacataatttagaagcagaaacagacatataaacacataattataatgcagtggataaatgatgacagagcgttgggctagatgtagtgagaattcagaggaggaagtccctaactttgcttgcatgagttaagggaggcttccaggggaagggaggtttcagttgggtcttaaaggatggatagatgttttctaggtaggctgtaggatggcattgcacacataaaggcgaatatggaagtctgttttgggaacagtaagtagctgatataaatcagggatctcagctgaaggctaagagggcccaggaagttaacataagtgagtgaagcaggtcacatacaaagatccacacgaacattatcagtggccctccgtgctcagagtaccatagggatgtgtgcggaccgtgggaaactggagagtctgcaccctgtctaagggaacagctgctgctgagctctgctgctagttgtcatatggaattactggcccagtgttgctacattttccagttttacaagagatgccagaaatccagatttctaaaatgtaaaatattgtcgcttttcaacattgacaacgatttcacatttgtaagctacaccatcaaaacatgtcttccagccattcctctgcagcctcaggagagtggagggggctggaaagaaatggaactgggaagggaaccagggccaggcaccctgctcttctcctccgcacacagtccagaccctgggtgatgcagaagttcagccacctgactttcaaaatctgcttttgaacagaagacagcacaaataaggtttaagaaactggagaagaaaacaatcaggggagggtttcatggcatgtccctctttccctttctgggtccaaatgttttatgtatggctcatttactcattggattctggcccccagctataaattctctgcaggccatggctggggtgggatgaaagctaaaggaacatgagaacggtgaggtgaggtcgtgcgctcgggagccacccacgctggatgctgctagccttctgttttcccgcaaccctcaggtctgggtttccctacaaggtctgccagccctgacagaaacagctgctacagatcccaagtgctttctctctgcaaagcaggaatacactggcctacagtggagactggaagtgtctggaggccttgtctggggacaagggccttgcaggcatcatggatgaagccaccctctcaggccctgcccccagatgttctacttttctatcccgatctctctcttcaatccctagtccctgtgatttcagcaggaaaatatctagaattgtgttcaaaccacagggtcaggcagagtgaacttgtttttgaaacaaaaacctgaagctctgctctttgggctctgagtgaatgtggctctgcagtggccggcagcccggtgtgctacctctgcgagagattggcagtcccagttcacccccattggggtctaggatgaaccagtcaccagctaagtttctggcctcactgcttcctcacgccctaccctgcctcatgtccacttcctctctgaagacaggactcagttgttctctgtcttctttgcttgtgagttggtcctagctccccactctttttcaggccagtagctgcctggggtgtaagggctagactagggtggtgtgtcctggagctagaaggggggttagaactggaccacacctaattgtcggcagtaatgggaggagcttgaggcagaggatttaagaggcagactcttgggaagaggctgaaaagcagagtgtctggccaagaagacaatccctgagccaaaaaaaaaaaaaaaggagctgcaaggactttgtagagtaagcaaggagccttgggcctggatggaagatgtgggcctatattgtgtgcccggtgcattgtaggtgctttgttgaataaataaatgaaggaaggaatgaaccaggtgtagacatgtaatttaaggttctcccacacccaagtcaggtagctttcctgttcagaagtttttggttaccctctcactccccacacatctgttctgtgccaggcctggactaggtatgtagggtggcgaggcaaagagagaggggagtgggactcagtcctgccgctgaggttcccacaattgatgtggggaagatgggcatggccacacacagctgcaatgcgctgtttcctgacttttgtgagtctcaactcctgcagacctgctacctctttctacagccaacttactagcacttcctttactaccctaaaatgaaactcctagaaaatataacccatgcacacacataatttcaccctgaagacactgcttgaggtctctgcaaattgaactaggttaaactttggacatcagtatcaatcacatgctaaatgttattaatgatattattaatattaatatatattgcttattgagaatgtcctgtgttgccaggtactttctacatattgttttaatctttgtactaactccatgaggtagacaatgttaccatccccattttacacacaaggaaagagaggtaatgaaaagtttccttaggaaattgcctgaagccacacagtaaatggctgagccgggattcgaccccaagcactctagcctcaaacccgtactctttccatgatactttgctccctcagaaacagcttctttagtacagacccttttcttaggggctgccatgcatcaaaataccctgagacctcctcttggccgatgtggtccctgtccctcttgagccacacatgttgattattctggcaaatatttaccctccattttacctgggttctactttcctgagcccttgtttttccccctctccaggcaactggaaattcaagttttaggtaggctatttcttagacaggagtggagattctgcaagtactaaataaactgaccaagccacgaggaaaccggctgagtcctacgtgagaacatgaaggtgtgggtttgttctgccaaagtttattggactcccctttatgtcatacactccctgtgttatattggggatacagaaataaatgaagcttggtccctgtcctgaaagctaccaggctagttgagaggacggtggggagttattttcagagggacatggccagtgctgtggtcacgggagagaagaggatggagctgaggaaacacaggtcaatgttaagcccagcagactagaacccaaggcaggattactggcacagtgggcaaagcgagtgcaaatcaggaacctaaagaagtggaagcagatgttcagggccaatatggctacagtggaggacattgtggctttttggattcttgcttgcttggggctcacttgagacaaccagatttagggcagctgactgaatccagattccacccaatttttggaattcttccccctaatcaagtggcagggaaggtcctgctcctaaacaagaacttacaaccacttcagcatgagcatcaaccagtatccttgtcaggtggcccccattcctctacattcctggatggtttgggatcccacagaactctaatgattacataagaagagtggcccgctctctccggtccatgcctccaagatgacaaagaaaagaaggaacaacagtcatgccaaaaagggccgcggccacgtgcagcctattcgctgcactaactgtgtccgatgcgtgcccacagacaaggccattaagaaattcgtcattcgaaacatagtggaggccgcagcagtcagggacatttctgaagtgagcgtcttcgatgcctatgtgcttcccaagctgtatgtgaagctacattactgtgtgagttgtgcaattcacagcaaagtagtcaggaatcgatctcgtgaagcctgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaagaagagtggcccaaggtaattttctaactgatgtggcactggctgcatagcatgctagaagcccccacgtggagctatctggccatcagggtccaagctgacactgggaagaggagctggagacaactaagacccagcagccttcccagcatctagcacacataacagcccaagtcagggcatgagaagcagtctgaatacaatgtcaagagtcacaggggtgtgggaaacactcaaggcaggtctgctacagatgactgtacttggggagtgcaggggagcagggtgaaatagcagtcctgggcatacaatgggagggattagcagagtcccagcaatgagggaaggaggggctggcaggagccagacagaccagcgtggctccccagctgccagctgaggctcaggactaggtgccaggtcccttgtggtggggttgctggagagaccaaggatgttggcccgacacacagtggccagtcaggaaaaccagcccctcgtggcaggggtggaggggtggtgggaggtgggaggcccccgtggcctctggggctcagcttgcttccaggctcagaggcatcacccagggcagcatacactatttgcagtccccctcttataccactttctgaggagggaaccccccagtccccggtcagactggattcactctgattccagagcagggccagttgagcaggaagaagggctttgaccttccctgcttacggagacaggccttggccaggcagagactgacatataaatagctttttattcactcagagctttaagatgaccatgtgtgccttttcgtattgtgtacagaccgcatacctatggcccgcacaatttgcatttgtgcagggatatggcaacagtaaaagtctgccaaactgctttcatttttctgatatgactgagaacttcccagtgccaagggcccaaatgggaactcccccagttttcttaagctcccttcatagacaggtataaacacctaaacagagctgcagacaacccccactccctcaccctcattcagggagacagtatcatgttcatggccaatgaaaatcaagactgtctcatggaaacagaggggctcacccgcattggtcctgggatgttgctaagcactttcattggtctgtttccccgaattccctaggtcctgcatttctaaccttttaaggtttggagtttctttgctcctaggccggcccacaacctcgtctgataggtaaaggacagaatctcttagacaacaccaggcaacctgtcttcccagaaaagtactaaatggcactagactctaaaattcatccctaaaattctaagagccataaggcagctccatatactgagtagaggcattgaccaggccaagggctgcaagtggcagacagcttgtgcttcccagttcctgcatctttaaaacaaagagaaaaatactccttgtacctcctgagggctgatatgagagcaaactaactaatcagagtgatcacgatgcactttgccaatataaaagtgagccggcagtgctcattatcgctaaggaatctagcccatttcctcctcttcctgtggttactaatgcagaaggcttattaaagttgagagtctggtggtgctgataaatgggccatgccatctggattctggctcccaagtcctagactgaggattatgctctcttccctggggacatttcaaggacggacactgcagagaaaggtttcagggatcacctttgccatgtgtttctggttctcggtgtctttacattgctggcaaagcaccttttgctggcccagagcaagattcagatggagcagataaatgagttgccgctgtgctgcactgggctggtttctcttgtaagtcttttttcatttaagcccccaaacaacattattaatttggtattgttattagtaacaacagagttgtgcagatggaaagactgagattcagagaggttaagtgacatctccaaagtcacaaagctaataagtggcagagccggaattaaaacttaggtttgtttaactcaaaatgcactgtgatgagcacacacaatagctgtcattcaccttgaaggtggtgaagttaaaacatggttgcacccttatttcccctcccagcacccccacccctggccacaacatacacatctcacttcatcatcctcttcagccaccatcctgaaaccatacctagaagcctagtgccctcagctttccccaaagggtctccacactcatgctctccttacctgtatttgagtttttatttctcagtggttgttgtggcaaggaggcaagggaaaagggagctattacctattgtgtttcccagttttgcagactttgctcagtaaactgttccacggaggccatcgacattggaggctgacttactatgttcccattctcagggactttgtcttctcacagggagcaatggctatggcccaggaatgaagctttccaatagtggaagtttaggcaacagccactgggtgacagagaagacactctggaatctttctcttgctcccccaaatcctatctgcctatactgagactggtcctgactgtgaaatttttagctcaatagttgtctccctaaattgggttccagggagtccatatgcaaatgtttcctgatgagaaccatcaggagatttctcccaaacattgtgaggcccagagtgctgggctgggtatagagaagggtggcctcatgctatggtacagcattgtgccaaggccagctcctagggctagcagcctttgagactgcccagtcagttcagatcagtggagcaagtctaaatagggcaaagaggaggcaagatgggaagccaagagtgtcaggaggtaagggttgccaactccactaagcagagggatgtactctgagggctccaggagccagccaggcagtggccagaagccttcttggtagggcctccatcctgagacaaaccttggttccacagatagctaacccagacctgtctgtccacactggttcagtgccattaagagttcactgcccttaactgtgcctttcacactcatgatgataacaataataataataataataataataataataataataaagcaacattttgagtgcctactatatggcaggcattacactaaacatttattggattaactcactcagtcctcacaataaccccataaggtagatactattttctccccctaataaagatgaggaagctttttcctaattctcctatgcatccgaggaggcatggagagattaagtgaggttcccacacttgggttcaaggaaaaggtggttattaggaaggaatgggagccagagtgcgtgtgggtaggggtagcctttagaaaagttgaaggacatgttgtcacgaaggggaagatgcagataactttattgtttggggaaaagtgacagagctcctgtccaatggccaccactttctcggaattcaagaggctgcattctcctgcttgagaaaaggtgacataatgccactggggtcctgaggagagtgctgatgctctatccccactgtttgcatgtgtcccagcccagcagactcaaaaactctctctgggatgctggagttggggttagagggcatttctcctccatggtgacaggagaaatgttgtcaatatttcctgtaggcaacaccagggcggggcagcagcttgtttctggcttcaggcttcttggactttactcgacctgtttcaggaaggtagaaaagcgtgtgcctccctgtctgaagcagtcgaaatgttcctgattagaacacagagtctttgcacacagaataatattcaaggccaggcacagtggctcatgcttgtaatgtcagctactcaggaggctgagacaggaggatttctagaggccaggagttcaaagttatagtgagttatgcttgcccctgtctgtaaaaatgaggaagaaggaggagaagaaggaggagaagaagaagaagaagaagaagaagaggaagaggaagaggaagaggaagaggaagaagaagaagaagaggagcaggaggaggaggaggaggggaggaggaggaggaggattcaaaattcacctgagaacttgttgctgtctgttggcttcttgccagggaaggccctgctgtgatccagggcaaagtggactggcaggggctatgaagcagggatggcagccagagtgataacagagtgctcccagcaggtggcgaggggctgcagaatgatgagagactagaaagaacctggtggcccagaatgcggatctgggggccagggcctcggtgtgtggttctgcaggttgtgccctgcgcaagctcacccaagtgagtggggacaatccaatagtcaagacctttatcctggggccactttttcctaattctctcaaaggcattgcagctctccaagctgtacatctagcaggaggaggcaccttatgaattcccagtgcccggagtgggtgagactccccccaattcccttctttattctctctggtgtccattttgcttccccaaaccccctcatacctgttcctactcatgagattttcatgttttaggggcatgtcttgcctaagcctcctgactctttattcttcctggagcctcactcctctataactccatcacccttttactgccagtgtctcaatccaggcccccggttcttacctcaggcaatgatagaaattatctagaaaacattgtgagtgcctgctttggcacacctgaaatctggtcacttaagcaatcaagatgaggaagagctgggaacgctcaaggctcctcccatccacctcgtgtcactcactgttccctttcacttacacatgtttactgagcatctagtatgtatcaaacactgttcaaggctttggtgacacaacaattcacaaaacaagcataaataaatcctctagctataactagcttctagttgtagttatagttctggttttggtaggttatgttcccttcgatttcaccattcttctctcttggtctgatgccctgaaaaccctcctcctctctctccctccagaaggcctcgtggtacttagacaccctgcagggatgaactgtttctcacatggggaacatatgtgtaaattttgctctccaagtgcctttgcatccgggtctggcaagagttccaaatcattgttctccaccttggatccactttcgtgtactatttattgtttttttgactgacagccagcaaaggcgggtaggggcaagggtggcaatgagcccaggctctgaaacatagcatttattaggagctgtggggtcatttttcctgttatttttcttgattgtggctgtgttgtccttcagtaagtgtctgtaggcttctatttgctagatgaggtagtggccggctctgtctctttcattcctccccttttttccttttttcttttttgcttaaaaaacactaaggaaaaatgtcagaagataatgtagcaaatgcctatgataaacatgcatatgaaccacccaaaatgaacaaatgttaacatttgcgtcatgtttgccagcaactttttctagcaaaagaaaacattacagtccaggcctggtggctcatgcctataatcccagcactttgggagcctgaggtgagtggatcacttgaggtgaggagtttgaaaccagcctggccaatatagcgaaaccctgtctctactaaaatacaaaagttaggtgtggtgtcacacgcctgtaatcccagctactcaggaggctgaggcaggagaattgcttgaacccgggaggcagagattgcagtgagctgaggttgcgtcactgtactccagcctgggtgacagagcaagactccatctatcaaaaaaaaaaaaacaaaacaaaaaccaaaccaaaccaaaaccacgttacagatgccaccgacgtccctgcattctcctcctcagtcctattttttattgtctgggctgtgatgcaaatccaggctatgtttatgcatccataaatggtatgtactatttggttttgcacttttaaaatttgtcataagtgctattatactacatgaagtaactctaaaatgtgctttcttcactcagtgttatgttttttggtatctgtcccttttacacccatagatgtagtttgttcatgttaactgctatatagtattccatcagatgaataataaaattgatttcttaatccactactgatagacacttagattatttctattttttaccattaccaactatgttacaatgaacattcttgtagatatttccccatgcatgtacagaaattttcagttgtatgtacctagaaagaagtcaaattgctgagttgaggggtatctgtagatattgcaaaatcgctctttcagatggctataccgatgcacagttctgccagaaatatctgagagaatctgtttctctacagccccatcaacatttcaccctaggccctcccactctgttctcacagtgaccgagtttcctagacactgtcataccaggtgatcatctcctatccagccctccttcctcttgcttctcctacctcactgccagatcaaccctatttaaggtttccttctccacaacatgttcccgatctactcctctggctggaatttaaggccctccacagatggatccaggcaacctttccaacatcatctcctgctgcctgccctcagcacacactcaggaagtctttggttcctccagattcttccacttgcgggtctctctccaacatgtccccacctgttgcctgcacacctctggtcctgccaccattctctacacctagtctcagtgttcacttccacctaggaaaacctcattcatttctcacaacttgcctcaatgacagctttcttggaagcctctccagataactccaggcagagtccccctctcagctcccactgtactttatatagcatttatttctctattatagtatttatcccagcagcttatacaaatcagacataaagcctcttgactcttttgcttggaaagtaagtgtaaccaaaatggatctcgttttcctttgttgcttagaattccttcaacaaactaaacaaatgtgtattacatacctactctgcactaggtgctgagtggtggctgagccagatgaggctcctggctttgtggcacttccaatgtgatggggtgaagggtgacatgcgtggttatcatcctctgagaaagttgccctcctcagtcctccgaggcacacctgtctgactggatgctcaattcctagtttctgtccccagtgcctggcaccaactaggggcctcagggcgagcttgcttgcatggcaggtcgggcattaaaagtcttggacagttgaaggaggagaaccatatttcagataagtcacagaggtgccaagaggccaggagcctgtgaccttcaggccaaccgccctgggagttgcctgggaggccacatgatttctggaacaaggcaaagggtctcaactgaaagagatgggcttggggatgagggaggagatggagtaaggacctggctacattgcagtcctccccattccttcctcttccagtccagcttcccccatgtccctctcattcctccaggagcacacgacactctcgcctggtctatccaacttaggctgaccaccctggtggtttttaaatgagtcatcttcctgtgtttgggaagggaagaccccctccaggttgcaaatgaaaagggtaggtgggggcctctcctgagccatccctctctccacccctttcttcaccctctgctccccccagcccctctgtagacattctctggccaagctgctaacagaaaaggaggattttctgtgttactaatatgttaacggtgcagctgtgactcagccctcatgccctctgtagaaggaggcttgatttccatttgcaaaaggcaatagggatctgatgagagtctttcctgtgtggaaacatttcctgctcttgcccagtcggattggcaccttatttaaacagccataacaatacatcctaaattgggtaagggaaatggaaaacaatgttgagaagaacataatgaccagaattgaatgtgagccttgcctcgttaggatttgagtgcagcaaaccaggaattaggagccttctctctggtctaatcagctgcttcaccccgcgcaccccaggcttctcagccatttcttctgagaagttagggggcccatcctctcactggattcttgcgacagtcgcctgaccagtttgcctgtctccattctctccacctccaatcttctccattctggggacaggacgctccataactccttatgacctctggcacagtttcctagaactgtgtaaactccaccacactaattgaaatgccttcaagaggtacagatgaacttttctttttacttgaatgcttgcatatttatttttctatatatgagagaaaagtataaccagcatacctgtgaaatccatgatttcacagagatattattgctgagaatgaggctgaagttcagaatcgtagactggcagaacagaaaagggcccgagggatcatctcgccatgcacatgtctttgccttcagttccaatttttgtatgctgtctgactacatctctgcgtgctgacctcctacccaaccttcaaagcccatctcaaaagctgcttctttcataagttacatgttgtctctcccaatagactgggaactgtttgtaatacgctcctcattttggggtccactcctccacccccatctcattcccagcacataattggcctcaagcaatgtttgtggaagaaattaatactcctaccatctacagcaacacagaataagtctgcttctccttcccagaacctgagcttgggatagacactcacagcgagctccttggtggggtctcaaagagagtgggtgagttccttgaaggctgcttggaaccaaggactccacctaaggacttggccatcatgaagagaacctcacaactcttcaacaaggcctcactgaacacctgcttactctgggccagctctgctgtaggtgccagggatactccatagccctctcttccaaggagatgctgcaacgctttctctgccatactcctctgtctacactgtgtgggtgggaagtagagccttcctgcttgcatatgtcaatgacaggttccagtactattttgacaggttgttccaaaatgattgctttttgattggtgcagtaagctttaggaaaccccccaatctccactcccatctctccagtgcaataagcagaacattttcaaactcttccctgggccactttagctgttgtctgagctgatccgcattctgtcgttcttaatagcttccctttcagagaatgacatgctcttctggactctttctctctcttctgaaatagagttggttttttcttgattagaaaagtaaaatatgtgtgtctgtttacttattggtaaagagtttgttacttaaagctctttatatagtaaagatattaacccttttctgtcctatgctgcaaatatctttttctttcccaatttgctattttctctttgatttttggtttgttgtgctttgggatgtgctaacatttttttaaatgatgctgccaaatatgttgacattttcctttgtgattttaatgcttagaaagtcttgcctcctcccagaccaaataaatactcatctatattctccccaagtggcgaggatgacattcatcgacctcaccccatttgagttcttttgggatccccttttctagcctccatgatgcccctccccctgcagttagcacaatttttcttcagttgaggcacaaagcagtcattaggctggagctttaaatatgctaatgagatcaccctttcccccgtcactctttcagcccctttgtaaaaggacagcttggggtggatccctttgcctgttgtcccgtctcccgcttcctaacccccttctttagcaagcggggagagaaagagaaaaaggaaagtgctaactaacttcaagtattggaggctacctagatgtcactccatttccagtgtacacttttcacctctcctcagcaactacattttcagttaggtccgaatccagagctcccagttaatggaaagtccctgcgcatctaaacactcagacttgagcaaagtcacgcagccaacagcccgagttccccagcaaccgccaggccgggcttgctgcatcttctccatcactggcacggttgccatgggaacgcgagcgctaaattactttgcgtgtttggaagctgaagacctcagctttgacgcatgtagcccagaaatcgattgacctccaattaggtttttgttgttttcttgaggcatctttctgtttgtgtcttgcctatgcctcttgaggactgtgttggagggagatctgagcatttagcttaatttttgtaaaaaattatttccaccttgacttattccaaaaagggtttaaggtggcttataagatacatcctatacttggagagaacctaaattagatgtaagggaggaagatgaggcagagagaaaacaagggtaacttgtgaagaagtcgtgatagaaagtgaatttcaggaagtcccctcttgataaatgtgggtcccaaatttgactttaacctttcatggcagataacaaaaagggaggtatgatcagttataagattcatagataaaagcaaatcaactgcttaacagaaacgcaaatgttccgaaccttgagactaaaaatctacttctttactggagattctaaaaaagatgtcacctttttagtcctatcacctagcatattacttgaacagatgaaagcatattctaaccttggtaggtggtttcttttatcaaaactttccacttttgttattgttgttgttaaataagtaaattgctttttttgtaatggcaaaatagaaaaaaatcgtgtaaataaccatggaatactatgcagcctttaaaattttttacggaattattaccacctagatttggccaccattaaccctttttttaaaagcggacattttcccatgtaaatcagtacctcctttctgcaggacagttgggcaatatgtttcaaaaggcctaaaaatgtatacatcctttgatgtggcaattctactcttagaaatgcatactaagggaataatcaaacgagtgctagagatgcatgtacaaagatgtgcatcaaaacattggttatgatgtaaagagaaagggagaaaattctgtgttccctacagtaggtgactggttatgtaaactatggagcatccatatagtggggcattatgcagctgttgaaaacaaagatggaagtgtctatttaccaacaggcctcctagactatatcaagcctcaccaatatactctctcagcaccctgtaccctttattcattgcagttgttattgcttcataatatatgtatttgtgtgcttatttaacgtctgcgcacacacacacacacacacacacacacgctcacacacagactggcatgtccatgaggatggaaactaagcctgttttactccttattggtatcccaagtaccttggtatgtaatagataataaatattatatttgttgaccaatggactggctgaagaaatgaatgaaaaatcaaggccaccaggcattcaattcttcaatttccctcccatccatcccagacttccctcaatctccagctgagccatcagtgctgcctacaaatacttttacttttgtctggtctctatggcagctgctttacgccttccctggctcttgaggccggactacctaccatctcctacttttagacgatgatatcatctcttacttcccagagaaattgggagccagcaagtatggagtccttcagtgcccttccctaccagggcctgattctgtgaacttcagacaccaggaggccattgggaacccaggctggagcacgttgggtagattgctagaaggcaaagccagacatccctgcccacttctctctgtgaacctctctctctagcaatcccctttctttctgccatcaagcctcttgaaaaggtactttattttctgcctcccattcattctgtccttgtttgcattcaagggcacagttaagtatactgttgtgcacaccattatctatccatgcaaggtccttaaatttttttatcttatttttcctttcatctctaatctccactcccagttcctctttaatggtttgatacatgctgttggaaatgtctttgaaaattacatagtgttttctgtgtttatgtgcttttaatttacataaatagtattgatccatagatcatattctgtttcttttttccctcaaccctctgttttgaggcctttcggtgctgctatgtgcacatctcgttgatcacttctgtctgacttggcactcatccaccacattttacttctcccttcctctgagactgtacatcttggttctgccaactgtccatgaccacaaataatgctgcaatgaaccttcctcgacttgctcctagggacctgggcaagaatttctctaaaccagagattttcagagtacaattcacagacccctcagagtttctgagactcttttggaggatgctcaaggtcagagctgtttctacgataacactaggacactatttgcctttttcatgaggttgatttttgcaccatttgcaaaactgttgccaccttagtgtgaatcaaggcagtggcaccagcctgtactagcagtcattgtattttgtatttttcaccactacatactcagaaaaaggggggaaaagccaccaatcttactgaaaagtagcttagataaagcagtaagaaatggcaatttttattaaatctcaagcctggagttgatgtctttttaatatcctgtgtgatgaaacaggaagaacacagaaagcacttctgctgcatgctgagtgagatggttgtctagagaagagcactgtgcaattgtttgaggtgtgagctcaacaggcctcctttttcctggaacgtcattttcacttgaaagaacaattgacaggtaaactatggttagtcagacttgagtatttggtggacatttttctcaaagatgaacaaaatgagcctgttgcttcaaggaaaacagctcacagtatttgttaccaaagataaaacttgaactttcaagtgaaaaacagaattttagaaaacttgtttctggcaccaggggcttgacagcttcccagttctttttttttaaattgttattaattttttttgagatggagtctcactctgtcaccaggctggagtgcagtgatgcaatctcggctcactgcaacctccgccttcccgattcaagcgattctcctgcctcagcgtcccgagtagctgggattacaggcacgcgccaccacgcccagctaatttttgtatttttcatagagacggggtttccccttgttggccaggatggtctcgatctattgacctcatgatccacccatctcggcatcccaaagtgctgggattataggcgtgagccaccgtgcccggccagcttcccagttcttaaaggctttctctgcctgccccttaactctttatgatctgttaggattctccagttccttgtccagaaaatcctcattgtaaaggacaccaggattgctacctgacctggcttgctaaggccctatgcatgagagtggacactgtctttgtccatcacattgcaggagtgatttggtctgcatgtcagggagctgcacaaatgttggactactgcacaggaaggctgccattgcagagcaaggcagagacacagagttgtgacacagagtttcaacatcagtgctccctgttcttcccattctccccactcagactggaccatctcacctgctttttggcttcatatacttccaagaccttgtgactgctccatttgtatttatttccagctctgagctctggatcacatatctttaccaccctctagacacacaaactgtgtcccaggcaagctctctcctcctcatccctgcacctgctggttttccagggttctctaacttaaggaatggcaccacccattctatctccatatcaccaccatggtctattctccctgtctggccccaccgctccaccctgaggcaagccttcatcatgtctcatctgggccccttccagagcctcctaactggtgtcccggcccctctccaatcagccttccacattgcagccaccctactgatcttcaggtcactcccttgcccaaagcttctgtggctcactatcaccttcaagataaaatccacacccattctcatgacatttaaggcctccctggtctagttccaactacctcatcttctacctggctataccagatcacttatttttcttcccaaatacgagaaaccctcatacctttatgctgttgctcaaaacgtcctctttgcctagaatgtcctctctccaaacctcattttactggcaaatgttgcttcattcttttcgagttcgacatcaccttttcttgatgcccttcccttcctctgagggaaggaattcagttctgggtgctgacaactggcaatgaatggatggctggggagtgaaaggggattgcatcaaatgatggctggggtggttgaggttgcagaatttgagctgatccctaaaaggaataatcttaatgataactaacatttactgagcacttgctatgcaccagaccttgctctatgcactttctatgcattctctttcagtctcattctctagcaaccccaaactcactgtatcctcactttagagatgaaaaaactgagggccagggttctatcagcggttatgaagctttactgaggggcggcttggtgatctgcagcagaacactttcttaccataaatagcagagtagggatagcatctagaatcacttgcaattatgtctgtctttcacacaaaggggaaaaaagtgcatttgacctcagaagcatgaggccatgtggtgaagcacaaagactagtctttgaagtccatctagctgtgtgaccttgagccaatttcctgatctctctgagcttcagtttcctaaagtgcgaattgaggatagtaatagctccattgcaggtttgtggtgcagatgagctatgaggaatgccaaagaatccagcatggtgttaggtacatagaggggctctgtcaacatcaattcatttttctccctccccagtgtctaaggaaagaagtgtagtatggtgaaactcacactacctcagaagtcaaaggagttgtggtttgactctggcactagtaaggctgtgcaaccctcagcaagttacttgccctctctgggctttggtttcttcctatacttgtaacataaagaagttttgttttacagcagttgggtgtttccattttctgtcattgaattgggaaaatgatcaggtcatgccaacctgggatgctgcgtgttgtggaagttaggcatatctgacaacgggaaatacttcctgaagacacagccttcggacccctggttacctagaagggagctcaggactcctcatcgacaaacataaaaccagctccctgcccactgcccaacctccaggagatgcccccacaggcttgtgtgagcccaaggcaggcctcaagctgattcaagggcccagctgcccgttgccatggcaacattccagctcgctttgcatagtgacagggatgctaggctttgctaacaaagtgctctgtaaaggacttcatgtctttggcagggacaattccgccttctttttcacatgaataactctgggggctgtgaggagggatttggcaagtcacttcccctgtcttggcctgcgcccttgggttttccttgaaggcacaagttggcagctttttatttttctatttccaaatataccatcactaccctcctcctgaccactccccactccaaaggaaagaatggtttttcccttacttagagctctggtgaactcggtgtgtttatgaaaatggaaggaatggactgttcgaatcactcacatacccttggctgattgctggatcaaattgtcctcaatccctttttcttttttcggaatgcccaatgtttttcaggattgaaacaggaagaccctatattgtcctggtgaattactccctggagcaggaaacatatttggaatcctgagtaggctgggaaggaagccaggcagacctgggtgaatcctgctttcatcacttacaagctgtgtgatctttggcaagttacttaacttcccctaatctcagttttctcatacgtgcaatggggatggtaatacagccttcatgggtatgatggtgaaattgttatgaggtttaaatatatcttatgcttgcctgcttctctctgtttccgtcaccctgatcctggcccatcatcttttgcctggactactacgatagcctcctgcccatttctactggaacttccctccagccctttgtttacatagcagacatggtggtcttttaaacatttaaatcatatcctgtcgctcccttgcttaaaatgctctaatggtttcccattgcacttcagataacatccacctcttaccccctacctcttccaccctagacatgctggcttcctttccatttctcaaagacatcgaggtccctctcacttcgtggcctcatggccttggcactttctgttccctctgccagctccttctcaggctcagttcttagctcggagagaacttctcttaccactcatccaaactagctccccatgcctgccccatcccttgccatcacacatcaccatgctgatttccttcatggcacttctcaggaactagtcctaccttgattattcgtgtacttggttattgtctgtctcctctgcctggattgtaaactctttacatctgcctcattaacctctatcacccactgcccagcacagggcctaatataataggctcaataaaatctattgaatgaatgaatgaggtaggtagagcattgagaacaaagcctgaaagataatagagtgcaatacatgtttgttactttctttttgtcttcttccatcatctggttgtaaggcagagggtggtgtgctagacctgtggcctccaaagtggatatatcgtctattagggtgcaaggagaaaatattagaatttctattaacagtcatctttatcatatcctaatttccatgtttgtttatgttttaaattttataaaactgattagcacagtagtacatatatatggtttatacataaatatgtatatatgggagtataggctcaaaaatacttggagaccacagctggtgggaagcaaactggcagactgttggcagaatgtgaactacagataggttgggttgagtcagcagagaggtttcccagattggaggttgagtgccttgggaacagggttgggggtggccagcatgcatgctccaggtctccaccacaccctgtggcttaccctagcctacttcattcatggccctgtccttcctgaccattacaggcgtgtgcatttccaaccctagagagggtttcctttgcaagtctagagaaccttctattctggaaattggtgctggtcgatcccaagggggaggtatgtgggaaagactgaggcctaggagccccctgtgggcagcagctggggcttctcattcttgtgtcctctgtaaccagaatagtacctggaacagagtgggtgcttggatcatcagagaacctgcttgttgactaatatcagtgcataggacaaccccctctgagtgtctgagctgagaggaccctcaggaggtaattaggttcatatgtttcactgtccggatggaaactaaatggggctcaaaatggccagggcctgcccaaggtcatagagcctcccgccagcactctttcccttgtgtctgcgtctctgcttagcctctggggtgtatgcttattcacgatccaggccttggctggttccacccccttggccttggcctactactcttaacaccagctctcagaaggcgttctggcttcttactgggataggggccaaaaaagaaaaacatttcccaaatcataattctacagcctcctgcctcccccaaactcactttctatgtaactaatccccgtgttccttggccattaatgacatcactgcctttctggtcactttggcccaaaatacaaagtgttctacctcccttgagtaggggctactatgtgtcaggcactttctaaaaaataaactttgtatgggcaattaacatacaaaaaagccacacacgttgatgaatgatcacaaattatacacacccatgtacacacttccaaggccaagaagttgaccatgcccaggactacagaagtaacccctcaaagcagtttttaaccatcactgcagatcttttgtccagcagccttgaggaaggtatgagtaattcaatccaattcacagataccaaattatttttctttaaaccaactcattccattctgcctcgaatagtcaagaaattacttttcatgcactcaattttcccctgtaatttttattagaatctagtatacattagaataaatatgtgactgttaaactttaaaagatcatccatgtatttctaaaattcctcatcatactatcacctcacataccactagcacaatgtgtactgcatttgggggaatactgtaccgtgggaattaactcaaggggaagactatttacgtttgggaagatcagaaaaggctcaagatggacctgagatctgtagagaggatatggctatgcagaggtgaagtcgattctggctgtcaggctcagagaaagcttcatgggggaggagacatttgggctgggtcttgagaaataagtctgacttttcacaagcagagatggaagtggaaggaaaagcattctaggcagaaggaatagaacctagagaacacttcatcagggctagaagagaagtttatgtttcaggcttgagggactgtgcctgatgtgcagttggaaagtgtctccgggcccagggttgagtgagtttgctctcttggggcacacaacacacaagcactatgaggggtagccgctggcaggctacagcccactggagtcagagtcagagtgtgtattagaattcacttttccttatggaacttgcacctggaaattccccacaccagattagagcatgtgcaggttatggcagatgggatcagcagaatgaaaaggagacaggcttggagtcagcctaacttgggttcaagtcccaaccctgccacttactagctccatttttttatctaatgtctgtctccgcatcttcagcttaggtcctaataatccacacctgacagggtggttgtgaggagtaagagcatgactaaagtgacaggggtagttcttgtcccagctcttgggttccggggggcagtccagagatagtaccacctgccgcacttccctgtccacccactttgacatccctgagtacagaggggtacagccagtgaggtggtaatgatgaaccttaagctgtttcactttggggacatgggcccctgagttgcttctttcgggcctcagacttctctgtctcctcccctggtgtgcctaaggcaccaagtagggtgggggaccagccaaatggtgaggcctggccctccctctctctttgatagaactgggtgctcctggctgggcttagcttgaaacacaggcgaaaaagaaagaagccattcttccccaaactccaagtgaagacaccacagggagttcagcccccctcctaaagccaccatgcctccctccctgagcacagtgctcagtgaaaaggctagccagcctttccagaccctctccataggcagtgatcttacagcagtgaacccatcagaacagcgcctccagcaccctacccaacctggatgtgcaccttgatgagtagaaagggatgagaaaaatttgagaagactcttgggttggtgggggaacaaggaccaagcatgtggagctttcagagggatcatcaaggagcaaaggagggctgggaggaaggagaggaaggaaggtctgcatgagcagggtagcttggcctgtgcccatgaatgggcagacactaactgagtcatcctctgtgcaaggccctccacaaggcacagcttcaaacacccaaactttggcccatcccgcaaagaattcataagttgctggggcagagaaggttcatgaatacgtggaagatttggaacaattccaggacatctatgtttaaggacaaatgagaggctcagccagccagaactgaaggtattgagaggaattatccctgcagactgctagtagggatgtgtgtaaagagggctttcaaggggtgatgggatttgggctgaagcttaaggagcagcctgtagggtttgggaacagcaggtagaggcggtgagaggggatgggaagcactgtttagcaagcacctactatgggcctggtgtcgtttagctcatttcagcattatctcatgaaagtcttacagcagcttacaagttaggtgttttcattcccccattatacatggaaaatggaagctggggaggttaagtaagttgtacaaggttacacaggtagaaatggcagcatgaggatttgaatctaggcttctctgaccacaaagcttttccctggtggctttaccatgaaatgataagccacaatgacaagataaagaagagaatgagtagcccagattgaatgggcagaggggtctgtttcagggaatcaagagagaggaagcaaagaggtcagatgaagccggttctgagtataggctggagagtgtggacttgacactttagacaacaaatcattggaaggttccaagcaatggagtgatgtggtttgatttatgtttgtaaaagctcactctggctgctgtgtcatgaacagattttaggatgcagaggtggaatcagggagcccactgaagaagatattcattgaaggggtctggggaaggatgatggtgactgggaccagggtgagggaagtggagatgatgccgtgaagtgctccaatttgagacagttctaaggagcaatttacaggactcagtgaatgcgtaggggagggagaggaaagcataaagatgtctaaaagcattcctcatccaatttagattattaaaaaaggatatggtggagaaagcactgaatgtggagatagacgggggtccaaaacctggctgcaccatgtactagttgggttcatttagtccagagggagtatgtgactcccagcagatccttaagcatctaatgggctatggccatggggacactggtgcttgggtgagaaaagctccaggggccacaatggggcttacagagaggaggaggtgaggacatgggacacgagatataggcttcccaaataagaagctcagatgagaagaggagaagagtggtgaggcagaaaggacaagggagaaaggaggggttccgcgtctgctcttctcttttgttgttcttcctccaatgggaacatcttgagcatgggtgtaggcccagtggaagaagccagtatggaccttggctaagctgcctcccctgtcttagcctgtttaagtatctgtggagtagattaaactagtattatctacctgacagggctggtgtgagaacaatatgcaatgatggttaaaaaaactgctttgaggctggatgtgatagctcacaggtgtaatcccagtactttgggaagccgaagtgggaggatcacttaagcccaggagttcaagaccagcctgggcaacatagtgagaccccatctctacaaaaaataaataaataaataaggaaaattagctgggagtgctggggtgctcctgtagtcccagctactcaggaggctgagttgggaggatcacttgagcccaggaggttgaggcttcagtgagccatgatcatgccactgcactccagcctgggtgacagagcaagaccctgtctcaaaaaaacagacaaacaaacaaaccgcttcaagaagggcttctgtagccctggtcatgttcaacttcttgacctaagtaggggtacacaagtgtgtccaggttgtgatcattcactcattcctcctccccaccacccccatgcctttactccccaaactcttccaaaacatacctgttcctattcaagcttcctcatgttcctggaaatataatccagggtcccaagtgcacaacccaagcaaattcaattctattttcactttcaggatgtcccatgcattctagaatcatctcaagttgtcatggtcctgtcttttctagcctctctgagcttaaagtccatgtttacaaccttgaagctaccaagactcatacctaggacccatcacaaatggataagaggtcaggaaccaaacattctccaagcttcagttattcacttatcaccttgaagatttttgctgtgttcaatcttcatgatttttatcatattcataaatgtattttcccaagatgcttcacttctggcccttcatgcttgctctgggacctctatttcccaagccctcttttctggcctcagatcgatccccttggaagcctcacattccacagtgagctgcaaagcccaagcatgggtcacactatcctgtgattcctctctataattatctgttgcccccactaggctgagacagcctgaagtcagtagcttgagagatgtttgtggaattgttgaagaaaactgaagagacccttgaaagctggagactcaacaggagaggttcctagcaggggtaatattccaaacagttaacagtgtgtccttcccctttctgtttctggccaactgttcttcatctttcatgacccagtccaagcatcacctcccctgggaaggtatctctagaccttccagactgaagaagcttctctttgatagtctcacaacattattgatccttctctgtattgtcatggcctttggacatgtcattcacaccctcctaggcaatgactggcacctctatctccccaacgctcacacagagcctggccagagcagatccctgggaactgctgaaagaatgactgaatgactgggcaggtgagtgggcagatggatgtggtgatcccactttagatctcttgccccaaagtcagaaagctctgctttctggatggcacagtgccccaagtcttccaggctgaagctctagccagacccacacccacagtgctttgtggccatgactattacagacaggccccctgtcccagtgagcagaaatctgatgacatcagcattgagcagtaccaccactcgcctgagtgaaggcacttgaggctgtctagctctggcagagttggttccaggagccacagcccttcctcacagccaggctgctggggctggaatgggctgctgagctagcaccacctgcccggtgtcgcttatcccagagggctgcagcactcacagtgagcggctgcgtaagtgtgtccgtgtgtgtgtgcgtgtgtgtgtgtgtgagagagagagagagagagagagagcgcatgtatttgctgtgggactcatggaaggagccctctcattggctgccaagggtcccagttccagtctgtgaatctctgggctgccagctctgccctcccctgggaaggcaaagcaggagagggaggggagagtggagtgaggcttcaggtgtgtctgacaaggaagcaggtacacctggtggccacactgggcattcttgtggcatctggctgtgctagctccaagtctgcagcctgacagctttgtgctctgcccaaattttcccagatttctgttgggactggagcccagagctcattggcagctgtcacttacagaactggatccatcccccagtggagcagggagctgtgtcacttagaattcctgggtagcacattccttcagtagaccctgtcacactcctggattaggctctgttattggccccgcgctcctgcaagcttctgcagacagagtgagcgagtgagcgagtgagtgagccagcgagcggcagcaggaatgacagcactgagagcagagacagccagggacggtgagggcgggcgagtcgggtcccggggggtgcctgtgctggccctttctgcagaggcagatgaagtgggggccactttcagggcttgctagggtttctcttggaacctgggctgctcgacccgagtggagcactgagcaagggggagggggaaagggagggggagagagagggaggaagagagagagagagagactgagagagactgagagaagctcctagcaggctctagtccaagtgagaggctcagatctgtacaattctgtgccaggggcacaagtgggatttggaagagccatgtgtgtgagaagcaaagctgaggtgatgtaagcacctggggaggagcacaggcagaggaggaggaggaggagtaggaggaggaggaggagaaagaggaggaggaggaggtggcagcggccgccgcggtggctgccagtccagagcagaatgatgggcaactctcaccacaagcaaccgaggagtaaaagccaaagcaggatgcattcagcaacaggtactcttttcccttccctccttttccggggctcctacagccagggcctcccagctgctgccatgcggggcccctgacccttggcgtgacttgcaggggctggcagggggcagggagagaacccgagggaaatgagggtgaacttccagctcccctgctcctgtgacaggctgaattgcataagtcagagcatcctgagctgggaggggccagccccttcgccggcaaccctgtgtagcctctggagggtggctggagtgtcagagaagtgagcagcgtgccagtgactgaagttcatggctaggactgtgctttctccctggatccagtaggcagaatcttggaaccatgcatggcttatcctttactagccgagcctcctttgttattcaaaccttcgtctccccccaccccagcccccatacccgccctgaacatgtacacctacacctctcctggctctacctcatatgctgcatgcatggaatgatccagacaaatctgtttcttgctgtgtaatgccctgccccccaccaccctgccccagccctgacagagctctcctcatgcatgggcgagaagagcatttgccggccttgagtttgttgttcccctacctctgggtgtgctctgctttgccccttccttgcccctctccagatatggactcaagggtgctggcatagttctccccaacaactccttcctggatgctgacactgtggaaatcaaggtctgcagacaacttttcctagctcaccttcccaggcggtgcaagaacaatttggaagcaacttctcttcatccattcacccatttccaccaactcttaccctcctatctaccccttggccacttgaaagtaccttccactgctacctggggttaggcttcatgcagtagggtcacaagtactttctctctgtgccctcctccctctgtcttggtggagttccctctcctcctttgtcagcacccaccacccccaccaccaccaccacacacacacacacccttcgcatcacacagagtccaggaggagcctgcagttccctctgtgcctgtttgggaagctctcattcaccattcgggcctgtgagaaggaaggaaaagtttttgccaagtttgactcacgtttaccataagaaagcaataaatggattgttgtcttgccaaaagtgtgccatgctccggcccagagggttgcctctgcctccttctggggactcagctggctatgcagttgagggtagttgtccaaggccagccagtcccaggggcagccctacaatgggattcttacagggcgtggtggggagagaagctacaggaaagcaacttgggatatgctggcacgcagggtaactgtttctggagcccgcctgtcagagcagggctttgtttggcctcctatatgggctgaatttgggtctctgtggtggactgagccaaagaataaaaattctgagcattgaagtttctttggaatctttcagggacatactcttccaaggccaccattaggtgaatggcccaaacaccacctcagagtctcctgcttctctgccttggagctgaaggcttaggacctgctggtattacatggagatgctctgtgcagcccagtacagaagcttgaagataactttttacataattgctgatgtgacaacttgggacagttactggctattgtgtcatttcttagaagttgctttgtatcttcaatgccagctccaatccagggtcatcctagacgtagtagctatgggaacagcctctggcagcacgaggaggtggcctcataactgcttctccctccctctcccttccacctcttggtcctcaccttaccacaacaccacaccttctcactcacaatccctaggtgatcccagaagccccgattgaacactcactcccactgggctaaacttgtgccactctttctcttcttgctcgcttttctctcttccattttcgcttagtgaccccactgtctttccagtaacccaaactagcatcctggtagtcatccttcactcctctctctctctccctcaccacacactttacagttttcactcatccatctatctgctcattcattcaaaaagtattcattttcgaggcctcctctgagacatctgagcccctctcttatcctactgtcagtgtccaaatccaggcctttggtcactctcgcttattccagaattgggctgtctgcttccacctctgaccttctcctgggcacgcccaacacagccaccagaatgagctgtccctgtgctcccttgctatgaactcaagtcttactaattggggtacgagagattacgattgctccccaagtgtggagtggatctcaggtggcccaggggatcattgtagttgtaacagagaaaactctttttgcctttcaagttctgtatatattttaatgtgtattcaaaaaatatataactaatacatcaaacccatgatttctcatatttttttaaattagggtaaggttaaatgtttttaaagcgagtctttttgaataaaatgattaagtaaatagtagaataggaagcacatggaaatggcaaaagttgggaaactgagataccaatgcctgaggcttgagaagcacccatttctaggataaagtatgttttccttagcacaacttagagatctttcatgattgggcccctcctacttctccagcctcaccagctatcatttctcaccttgaacttgatccagccatattgaatgagttgaaggtctccaaatgctcccattcagcattaccatgctttcactaatgcacttttctctgcctggaacacctcctccacctgctatcttctcctgacagttttctcttcagccttcagaatcctgatcctgtgtttcctcttctctgaaactgtccctgactgaccgccttccttcatacaaattaattaataaagttcatcaccccctcctcggtactaaattgataccttttacataattttatcattgctggtattatcatttttatacttgttattgcatgtttatctcctcctagtaaaatgtaagcttttctagggcaagggctacaatttgtataccaaagggtgggaaagaacccttgaccaagactcagaagacttgggttccggtctctcttacccagtaacctgcagggtgatcttaggcagctcatccacctctgctacctctgtcctttggctataaaaagctacaaatcctcagggggatccttagcacattcccagggtaattgggaagatgcgatgtgagatagctaggaaagcttttgaaagttgaaattgcttttcaaacgaagaagggtgattatgattgcagagggaggaaacttttcccagaggctggagccagaagtaagccccacaggtttaggagactgtggaggagcagccaggctgagctgcagcagggaaaggatgagcaaaaccagccacacagccagtaagggtgagggtgggggcgggggggagcggggcagtcgcagcacgtggaagcccaacaggaccttagagcataggttgctttaagactggaaagccttgtctgccaagctcatgagttgggattgagttctcaccaactctcacctttcgcctattgagtgagtgtagccctgtcaccctgtgaatctgtatgtggtggggagggggatgcatgctagcgccaccatcactatacagcatacgcatagctgtgcatatatggaccagctgtttgaactagcatcccatagagaagagaaagagagttaatatccatcatgcacctattatatgccagcacttttcatccacaactttacttagctcagagaaaccaccaggcagggattattgatgccattttacagataagaaaactgagacactaagggagagctgccccatgatccaataacaaggaagttgtagagccaggatttgagcccaaatctgcctaattctcaagcctgtgcctattgcaccataccatgtgcttctcagcatctttgcatctgtgacaggcattagtaaccctggagactggatgtggtggaaggaggggtctgggcttgcttgtggtagggctagcaaatctctatggcaacaagggctgcaatgcccagccttgtagaagtcccaccacatatcgtttgatggcatatttgtattattggaataactgaactcattggggactccatgctgggtccagaagctagagccagggattcctgaggtaataagaaagtagaggattcttgaatttaagcctaaaccaggttaggctgagagaggcttcagatccagacgactggtatcatgctggtttccaacatccctctccccgcaagcaaccgaatcagcactgtaaatacggtggcctgtgcttcaggatgaaaatgagtccaccattctcttctctgtacctaaacaaaatgaggaaatcatctcattacatttgcaaggcatttttatagttgacctggctctttcatcttcacaagtttattgaattctcacatcctcgatttcagtatggtggaagctaaaatggcagagacttataagggagtccattgacccctatccccctgggagcttcttcctaaagacctattttctagtcagacttaatgagtccattggaaggtatggaagaagttaaaattctaggccaccgaacaaaatatttcctggtgccctcctcccatgactgagagatgtgttggaggcagaggcacaggccctggggattggggccaatcgtgatatgcccacattttctgggccagaacatagaaggaaacaaaaagtaggtgtaaaaagaaaggtacaatggccaccctaatgtcaaatacaaggggaatggcaaaataaagatgttgcatccaacttcactgaaatatggtagaccatgaaagctaattatgaagacttgagcaacatgaacaatgcttataataaagtgtaacatgcaaaaggcaaaacacaaaactgtttctatgctgagcttcacaaaccctgcagaaagtatgtctgcacatggccaataattggaagagaactgtggaaaaatcaaaacttgatttattgtgggtggcaggcttggtggatttttctttcccttagatttccattaatgttgttataatgttgtttgtgcaaagaataataaaaaccattaacacatacaacaattacactgggaaatcattctgtcaagctgagagaccaaatcatatcatttccctgagccagcaaacacactcggaagacataaagacaaaattaggtacctttttggagagaggcagctacaaggaatggggagagatcatgaaattagtgtgggaagctgcacgtttgaactcaagttcagatccttatgttagagaaagctgtttcacccctgtatcctcagtttgttcatctgcaatgtatgaatgttgataataatagcctgaggagcaaatgatctgggacattctcaaagaccttgtgaagtgtaaaatgctgcatattgtaaaaccttatcatggcatgtgtatggatgctttgaaacaagagtgttagatactgttttccactgtcacacccagttgacaacaaagccagcctgggcctgtgctgctgggtggcttcagttagcaaccaccttgtcttctctcagtgctgggtgccattgaaatctgattaagcaagcaaagctttctagttttcgccttggatgggaaatcatcaagaaaatgttgtgggtttttctcttcctctaaaatgcttgaactctgaacatggtgaagacctccacagctcttggattctcagctagacttggccagttacaagctgtgtgtcttcaggcaagtgacctaagctcatcgagcctccttggtcagttggaattaatagtgcctacctcatggggtggttgtgaggatgaaatcaggtgctgcatgtaaagcacctgctatgtagtaagcaaggagcgtgtgtgagctgctcttgttattgctcaagatgatcagggtaagaagggtctctaaaaatcacctgaaccaggggttctcaatgaggcggtgagagggatgtggagggggtcttgggggagcacagtgtgtgtgtgtgtgtgtgtgtgtgtgttgtgtgtgtatttttttttctgagacagagtttcactcttgtcacccaggctagagtgcaatggcacgatctcagcccactgcagcctctgcctcctgggttcaagcgattctcctgccttggcctcccaagtagctgagattacaggcatatgccaccacgcccagctaattttgtatttttagtagagatggggtttctccatgttggtcaggctggtctcgaactcccgacctcaggtgatctgcctgccttggcctcccaaagtgccgggattatagatgtgagccaccgagcccagccgaacacagtgtatattatatatggtcatgcatattattatttttgcatggcaacattgaaaagtcttccacgagaaaagcagatttttttgtctccattatggtgagacccaggtattttagtaaaggtgaggtgtgtgcttagaaaccactaatctcccacaaacctttcattttatggatccacaaaagtaaggtgacattcccagggtcatgcagctacagagatcaataggggcaacagtccagtttctttccccaccactgccaccaccactgcccaagagttgttcttatgacctctgggatttcctcattaacagagtagagacaccctaggccacatggtcatggccgtacagccattatcaagctgggagaaaccagacaaggctctgacattgaaaagaggcaaaaatgatgcttgagactacaaggaaagatgtccttggtaggagaccctgcacactgatgtgtcagctcctcatcacccctaggcagtactttcaaacaatctgggctaacgtggcctcctaagtgccatctccagtcatgtggagtaaattgtctttgatgaaaccttcatttctctcaatagcagattttctatttcaaaagtcagtttcctgtcaaaatctcccagagcacagacagaggggtgtgggggtcccaggagcagggtgaggctcctaattgctccccaccattcgggtggagtgtgttctctgagttttgtttttggcattagggagggtagcacagagccacctctatcaattccttttgtggaattcataggcctggtcagggtggggtgcaggtggggtgctctttgggccctttaagcttgtctcagagatgtgcaatcccctccccgatgccacacaggagataaaagtcatgcactgcccctgtggaatattctgacccacctagcagcctggggccctgcttctgcttctgggacctggctttgggggtttctagcttcccaggctgagctcttcacactccccccacctccccactgttgaacactgccacttctggcctctcccctgccagaatcttgactatcccaaccctgcaccataaccgtcttcctggctggcttgggggatgggagctgtctgcccagggtacagagcgaggttggaaaggttgagagtcatgatgctcagagccagaggtcacactgctggttctgaggatgaagatggctccccaccgccctcaattacaggtctccaaccccagaaacatgaggtctgtgtcatggaaacttatatacacagccgtttccccacccagggacaatagcttaccatgactccagcccaaagaacgcccaaacctgagttgggggaacaaaagacaaatatggactgggactctaatttgtggagtcttcccatctcaaataacatgtggctctggccatgtgcaatgtgcaatggcagctcctaccacagcaacagaagccacctccagcccagagggatccggggtgagatgtgactgtgaaacaggatgacaaactcaggtatgtgtgaggcaggccagagacaatagccagtgggagagccaagcccagagtaggagcagcagtgttttagaaaggtggccctcctgcgccttagagggaaggcccagggtaccggtcagaaaggccataggaggactgctaggaaacacgggccagctccagcagggcttctgtggagccaggcagtagcttgagcagtgggcagatatttactcacagagtcaacatagcaactttatggcacaggtccttttattagctcctaaagggcatatataaatgagaaaccgtagactacataagtgatctatagattagaaactgaggctcagagaggttaagtgacatgcccaagggcacacaggctgtaaatggtgaggctgggatttgagcccaggcagtagggctcccaagtctgtcttcttagcccctatgctaatctgccaatgtgaggggggtaagagtcaggctgtccttgcttttagcccactagctgggctttaagactggactttcctaaaaactggtgcaatggttctccacctggggagatttgaagcagtatcaatgcctaggctccacccctcagaagttctggtttaattggtccgaagtgaagttcagccttcagagagtacagagggtagggtggaactgcagttttcacagaagctcctcaacttaaaaacacacagcatctctcccatcctgacaaacatctgactcccttctctagttctgcctctccctccagctacggccctctttcctctctaaccacagccagacttcctgagaggtgtctcccctcccctcccatttccctccttaacctgctgcagtctggcctccgtgaagccatccttgccaaggtcaccctctgagtggtgctaaagtgaacagtgcttacgcctcggactacttaacttcttgaatgcatctaaccattccttgctcctggaaactaaccctcttcccagctcagggacacaatgcattctccttgtctggggatttcacctcagtctttttatatggcttctgtaccatgctgtacaaatacattctgaaggtagggtctccagagacccatgcatgagccctggccctgccctcaaagagttgaaagtcttttcaacgcagatggctctggccatgtgcgaaggtagacctccatcttgagccttccttcaagctgtttccttgtctttctgtgtccctggcaaagatagaaaagagagtaagtctcacgctgagtctctttccaccctgtgagcaagagccaatgattcctctcttccgattagaagacagttactggaacgagggctcaatccatcgcccatgctcattttgccaatgtagtcatttagtaatgaagaacaaagaagtccctttgtaaggagcttctcccacatgcgatttgtttcctgggtccttgtccttccaaacaaagagaaacaaattggaacaagatatgttttcagtgtttgaaagccagtgattctcttgtgctttgtgcaccaggaaataggctttgctggaatctgcagtctattggcggaagtgtaggtaggtgaagaggtagggaagatcggcagggttctcctgatgccacgaagagcaagctggatgaccccaagtctcatcctttagctgttgggccttgggaaagcccctttccctttctgagcctcagtttcctcctggattaaatggaactagttgtctttagctcctctgtggtgaggatgataggagatgacctctatgtgctgtagagtaggccattgctaggcgttgggggaaattgaatggaattgcatccagccgtagttcacagactcgttccaggccaagagagaaagtgtgtgtgtggaagagagacttgcaaaaaacaaggcctatccctgtgcacgcctctcctctgggaaggaaggggcctgcacagtgacaatagaccaggggcgctgactcagacagccagttcctgttcatttcccctcactgcaggacagccgctgagcgggaggtcagccctctgaggggctctgactcgggcctttggctgagaaccttacctagagaaagacaagcccaactcacagtaaacttccctcgcctgtccgctgtgactgggccgacgggtccagggtggctgtgggtggagtgcagcggggtggagaaagagagaggaaactcacttttgaatcctcagttgctttccctaggctgggctgcccaggaacaacttcaatgggcaaaggagtatgtgatcgatgggaccaaggtgctgggaaacggggttcaggaaagtccctgggcacccactgaggagcctagggacagggtttgggacagtgtggagcccgtcggctccctgcccccagtgtgggctcagcacacacttttctcatgtggattcttggttatccacaccgctgggatggagagaactgactctgtcaccctcttctggatccggggaggtgagtcgttgggggaagaagggtgcatgctcagcagaggggaaaagggaaggaactggggctcatggaggaggaggagctttctgcactcacagctatgctgaggcagcctgggctgctttgggagggagtgggactgcgttctagaggtgtgcacagaggggcaggatggccacttaaccgagatcctctgaagggaattcataatcggatggctttggaagacagggtggatgtgatcacatcccaaccctgatattctgggatcctaaaggattaataaaagtgatggaggaattctgcacgtgtgtgtgtgtgtgtgtgtgtgtgtgtgtgtaagaattactgcacctcttacttcctctactcttgtcccagattctgaggccttgtcccttcggtggtagaaaattccatctcattcaatccatctcattcaatcttggggctttatttgcctcctggactcctgctaaaatgctgaatttatttttgcaataccaaggcatgtaggcaaggagaggcaggaaaggggttcctgtcactggtcttctgtacacacaggttgctaccaagggaccaagagctttctaattgcagttcaagccagacctcctggcagtaaggcagaagcaagtacagggccctgtgccacactaggacccctctctggcttctgtgaagaagactagccacgtggtggtgggggagggggcgcgtgatgccacagtgacatgcccttgaaaatgtctggaagctactgcttgtggaggtagctggcaggacagactgagtccatgctgtgtctctggagttttagttggccctttgcatcaggcgtatgctcaaaagcagtttatgagctaaagtggtgacgggaccaaaaccgaagtcccatgaggaccacgtgctgtttggcatggagaagaatcagaggaaagtgatctttggtcttcaggtctttgagggactgtcactggatgatgggagtagatgcggtctgcgtggggcctcaggaggcaaagctgaggtctgtagacaaggaggaactttccaacagaccctccatgggtgcagtggcctgccttgaaaaggagccaagggtcttggtaacttttgcaggttacttttttcacagagacacagagtgagccctagagaagaagggcatgtaggagcgagctttctgcttctgagggagagagaatgggaaggaggggccaccctcacctgggatgaaggcccaacacccccctgacctccaccttcacaacttctcacctggtttggcctccctcatctctctccctcctatggggctccctgcttccactctccagcccattctccactctgcagcatgagcgagcctttaaaaaacagacgcagctgctcaaaatcctgtgatggcctcccatggcccactggtgaaagtccggatttatttctcttctctattgcctcctttctactctctaaaaacagagctgagataagatcgtttctcactctaacacagctctgacatttcataaatctttgtcctagacaactggaaagggctatatttaaccttccgtcctgtagcttttaatggagggacttgcttcaggcactgccttctaatgccacaggagaccagagtttttctttgttctctaccagcagagccgcgacctcgacagacagaggccacagctggcctctccctccagtgagacgcacaagttgcttggccaggcatcggccctagagcatccaccttcccctgtctctaggtgaaggaggtccctgtcccaccctgtgaagtgtgacccttcaactttcttatctgcatatacttgaaagactcctcattaaccccatagctgagataagtgggccaggtgagcacaagaataggtcagacagggcctggaggtatgggcttgggagtctgggctaggggagggagccagagagaagaaaatgtatggtcaggaatctggttgcgcagggtgcaggggcgagggtggggaaggaagcaatgctaagtaatgtaccaggcctgtgctaggagctttgcattaattgcctcccctttcctgcctctccttgcctacatgccttagtattgcaaaagtaaattcagcactttagcaggagtccaggaggcaaataaagcaccaagattgactgagatgcattgtctttgcattgattgtattggttgtgtgatcctcacaaaaaccctgtgaggtgggtaccatccttacccacattatactccagtgaggaggcttaagtgactgaaatgacttaccttaagtcatacatagttaggaagcgacagaacagggattgaacccaggcccatcaaactccaaagcttagttgctttgcccagtcccaggatgtccctggctgacctggcactgccctttggagcagctctgatgtgctggcctctctcatttccttgggtttcttttataaacacttgagcctctggtaggttctttccacactgcccatcacacaggcctcaggcccaccgccaacctcggccaggctgaagagcgcagcagtttgatatctctgatggtgccccatgctctcaggcctcatgggctggcttctcccacattctgtactccagccttgcagataacagctactgggatcagtagcctaaaacaatgaactatactattgttttttttcatgttaacagttccctagactgctaacactaaccacctctgtggccttggacaaattgtgtcccttctgtggtcccagcttccccagagtgggaagataagacactctctctggcccttctgattcaaagagtctaggattcccagggtccccctctctccagccccaccgttgctggttcccccctacagtgttgggatgagggtagccaaaggcactggtttggaaaccttcgctgagccaagcaatggctccagagccaatggccacagcgacagagtggcaataacaaccacatttgtaggctactttagtgcttaccaactgttttcacagtctgcgaagtggcagggagggaactccaaggcgattttaatggcacatagtacatctttaaagaacattgaattacatggtgagaaaatgattctcttttccttctctttccagctttctgattacatcaaggacaaggtctcagtgtggtgctattcttcaacttctgtaatgcttactaatcttcttttgtaacaaagctagagcaggcctcaggctcaaagacatggacaggcaacaatatctacatagaatttaattactctcttctgttctcattgtatttctttatacagccactttctatttatggcaagtgatactccttttggttttggttatggtttccatatagaatttcttttaatatagatttatttgtttaagaaaaaaaaacaattcacttagagaaaaagattaagtgaattgtaaatagaaccagtggtgcctacatacagcaaaacttgtgaaactggtaccctaatggccaaaacttggggaacactggaatgtggcattcactcagcaggtgttttctgagcaccaagttcctaaggcctagaaggccctgcacgatctgtctctactcttgtcccagattttattgccccttactccccctgcccacacactgtcgtgccttccagcatgttgcatcctttttctggaatgtctttcccatatccttgcccactcatcaaacctcagcttatccttcaagactcagtttaaatggcacctcctccaggaagccttccttcaaatcccccaggttaagttcagcttagcaccaggttcatgtctctattgtagcatctctcacattcccatcattcacttacaggcctatatcctccacccttggttgccaatgcattttataagaaaagcttgagaagagagggggagagagaatataactgtgagtgaggcctatgtcagtgactggtcctggggactatcacagctcctggtgtcacttggaattgaggctttccagatgccaagccagagcctgcacaggccacaaacccagcctggggtctgcaggtcacatgcgggaagtttattggggtactgctaggatcagcatctagagtctaagggaaagatgcaggactggttggagggagaaattggactatgatgctgtcctaatgacagcctcagctgacacttggggagctctggagctgggttggtcctttagagttgttctgagtcagggtgaggggaccagtccttagatgcaggctgcccccaggaggaagcatagccttgagcaaagcatctctgtctgaggaggtagctgggcacttcccaaagagggccgtcagccagcagcagttccgcggctgagggaataaggccttcagtcctgaacgggaatctgggcacacatcacagtgtccaccacacgggtctggtcagagcctctggggcttcagtgctgaggaggcagcgaggagagaacagtggtttggagggcagagtgtggctatcaagagctggcagctggtaggacctagtaaatgtttgctaaaagacagaatggctgggtatgatgttccagtcaccgggcttacaggcaaggaggttacagaggcaaacaagtcacagggaacttctggtatcaccagggcgacagatataaaaagggactattccagaacagtgcagtaagtgatgtgatgtgtacctgtgatgtgtaccaaagaccaggtttccacagcactttgttcgtgcttttcttggaggccttctattatgacccttctaacaaccctctaaggcacgaattattgtcctcaccctaaacatatgaaaacagagatccagggtttgctttagacctcactgcaagtcagacccccctggctgggatgacccccagcacagcctgccttcatagcccaggccctctcccctgtaccacccagcccctctcaaagacacatgcagttctttgcttattacatatatttcatcttgacctagccctgcaagatagcaaaataagggtgtcagaagaaagtaggtttttacctttattttcttaacctgcccggtatgctttcagaaatagatatattcggatcatatttataaccatgacattcttttttaatctggttttctttttcctgcaccttcttaaccacctgtgaaattcatccattgcactcatctgctcttccatatcttgtctcaaacttgagaaaactgggatcaaaatccagttagttccttttgagctgtaaggggggaaatacaggtattttaaaatgtcagccttattcaaaaaagcaaaactttcttggtttgaaacactaaaaatgtgtgagaccaagaacacctctgattttctgtatgatcactgctctaggagaaattctttgttttttttttgttttttttttttgtgggggggtatagtttgaagaaaataccacatagaggcaactaaaaatcctctttgaggagttgggtcccaggcagtgcagctgctccctactccctccctaccacccgtatgctgcgccctctcccccacctttgtgcccaccctcctcctcaaactccaggccaagtcctttttctcctcttccttccctgcctaaaagattcctcggggcctccttccctgtcagatgccaatgaagacaaattttgaggctgaacaaaaagaattctagcatctctcccaatgggcctccttgtggtctgcctggtcccagagttcacctaaagcacagcttttctctagagctttcctagcagaagtcataatgctgtagggaaccaacagttgttttgtgttccagaggagaaagatgttccagcttcatatgttcccagcaataataaagatacacatgttctgtagccctcacatgacttcatttcccatcactaccacaggaccctaattaaaaatttcctttctctttggatctaccaaaatatcttgctggcctcgttggttaaacaagggggccctcatttctcatacttccttatagggagatgcagtaagtaatgggggtcacagggaggcgcaggggtcggctttctgctgtaagggttagcaaggtaggctgggcttggtggcttacgcctataatcccagcactttgggaggccaaggcgggcagatcacttgaggtcaagagttcaagaccagcctggccaacatagcaaaaccctgtctctactaaaaatacaaaaattagctgggtgtggtggcaggtgcctgtaatcccagctactcgggaggctgaggcaggagaatcacttgaacctgggaggcagaggttacagtgagctgagattatgccactgtactccagcctgggagacagagtgaaactccatctcaaaaaaaaaaaaaaaaaaaaaaaaagcaaggtaaataaaccacccttatcaagatgtaattttcaaaggggtaaaaacatgagtctcattcaaatgtataatgatcacgtgtcaaagatttatttaactcattacagtaaagctgattttttaaaaaagatacgagagttaaacatagaattaccttgaaaagttaaacatagaattaccatataacctatcagttccacttctaggtatatacccaaaagaagtgaaaacagagacttgaacaggtatgttcagttgcatgaatgttcatagcactgggctgtgagagggcctgggctatgaaggaaggctgggctgggggtcatcccagcctggggggtctgacctgcagtgagacattattgacaatagctgaaaggtggaaacaacccagatgtccattggcagatgagtagagaaataaaatttgggatatccataaagtggaatattatacaaccaaaaaaaggaatgaagttctgacacatgctacaatatagtttagtcttgaagacattatgctaaccgaaagaaaccaaacacaaaagaacaaatattgtatgattccacttatatgaaacatgtagaccagaccaattcagagagacagaaagttgactagaagttaccagggcctaggagagggagaaataggaaattactacttatcagttacagtgtgtctgtttggggtgatgaaacattttggaaatccatagtggtgatggttgtacaacattgtgaataggtttcatgccattgaattgtacacttaaaagggcaaattgtgtcttacgtatattttactgcaacaaagtagttttaaaaaggtgtgagagacttcacaagaatgctggaataagatttaaaagttggggccaggcgcggtggctcacgcctgtaatcccagcactttgggaggccgaggtgggcagatcacgaggtcaggagttcaagaccagcctggccaacatggtgaaaccccatctctactaaaaatacaaaaaaattagccaggcgtggtggcacgcacctataatcccagctactcgggaggctgaggcaggagaatcgtttgaacccaggaggcggaggttgcaatgagccaagatcgcgccattgaactccagcctggatgacagagcaagactccatctcgagaaacaaacaaataaacaaaaaaagttggatacaaaactggttagttctggccgggtgcagtggctcactcctgtaatcccagcactttgggaggccgaggcgggctgctcccctgggaggccgaggcgggctgctcacctgaggtcgggaattcgagaccagcctgaccaacatggagaaaccccgtctctactaaaaatacaaaaattagctgggcatggtggcgcatgcttgtaatcccagctactcgggaggctgaggcaggagaatagcttgaacccgggaggcagaggttgtggtgagctgagattgcgccattgcactccagcatgggcaacaagagcgaaactccatctcaaaaaaaacaaaaacaaaaactggttagttctacagagtaatataacggtaacctttgtggctgccttttctaccggacagaattaattttcatttctaccagacaaaaatcatttgcaacttctccttcttctacaagttaacttttaactttaccgagtctggaacttaattaatagggaattgtaagtcaaacagctgcatggatggtgctctcacatgctcctaaaagggtatcagtgatattttttgccttgtggttaagttttagataatttttcttaacaccttaaataacacatgacaaagcacaactcccacatgggtctccgtgaaatggccttgactttggcttcaaggcctgactcttctgggcattaacaccttagtgacattttctggggtcccttatgaagcctacttcagtccatactacacatcaccaccagactgaccaggctgcagtaatctgtgattgcaccactgcactccagcctgggtaacagggagaccttgtttcaaaaaatcataataaaaaaaaagaaaggaaaaagttcgtctgggtaccacctcaaatcgctttcatttcatatttgattgtgttctaattcattggtgcgttggcctcacatgaagacggcctttgtctccttccagcatgcagccctgacctaagcacttggcaagtcctcactacatacccttcggatggccgattgtcctgtcctcttcataagcttgccatcagaatgctgatgactttccctttgcccctttactgtgcacagagtcattgaaaacacatttcctgtcctccagggacttatattctgactgggggaacaaaagcaggtgtcctagactagtcaggaagatctaggttcctctagatcactttctacttgtgtcaccttgaacaagaagcctccctacccctcagtttcctcatcaatgaaatgagaataataatgtcaatacttgccttgcctacctcgtgaaatggacaggaggatttgttaaaaaaaaaaaaaagtaataattgtggaagtgcttcgtaaacaaaagagtgattattcacattatagttaaatgattctgtggaagttaactagcaatacaagatagcccaataaagaatgtcacaaggcagcttcccaagctcagaatgagtccctggggtactcactcgctaatgggcaagaggattccagagggcttgtaggaggtggctgggtctatagcgtgagtgaaaggaagttcaatatactaggggtggagtggggaggaagcagtatctaggtgcatagagcatgagggaagcaaattgaataagtgaagaaagatgaacacctgcttggggctggggaggcatcccagtggcctttccagaggaaagtgtgaaggggcagtgggagaaaaggtgagatgcaaccacagcaacacccaagccaggcttgggagctgggtctgtctgctctgagaagccactgggggatctgggatggaggagtgtagaaggaaaccaagttttagaatgcagatccctctaagagtgggacttgttatcctgcctctaatttatcatttgtgcattttattgtaaaataaaatactaacttattgtacaaaaaaaaaatctaaagtgaatcaacaagtatttagggtaaaaaatgaaagtctgcctttaacttgaccaattctagtctttttcgaagactacgcacagtaacagtggggctcatatcatcccagaacttttcctatgaatatgcctgcatgtgtgtttgtatttatatcttgtttttgtcgttgttgctgtttgtttgtttgttttgttttgttttgtttttgagactgggtcttgctctgtcacccaggctggagtgcagtggtgcaatcatggctcactgcagcctcgaattcccaggctccagtgatcctcccacatcagcctcccaagtagctgggaccacaggcacacgccacctcacccggctaattttttgtattttttgtagagacagggtttcaccgtgttgctcaggttggtgtcaaactcctgagctcaagcgatcctcctgcctcagcctcccaaagtgctggaattacaggtgtgagccaccgtgcccggccgtatctttttacataaatggaattatttatgtattttacaccgagccttgatttttaaaacttaatatgtctatggacatctttctatggcagaatatatcttcttttcaatagttgtatagtattccttagtaagaacgtaccacaatttatttaaccaatcccctattgatgaggaattctgcaattaattttgcttttgcttattactattacatttttaaagtactatatgtctgtggaaagaaattcaacagtgtaaaagactatttcatgaaaaaagtcattctcctgcctacccctaaccccccatccccactttaacagctcctccctcaagaggcaaacacagataccagtttctagtgtcattcccaaaatgacctgtgcatatacaagtgtatgtgagtgtgtgtgtgtgtgtgtgtgtgtgtgtgtgtgtgtatggagagggggtggggaagaaagatagagaaagatttttaatgtaactgatgacatactatacacaacattctgcaccttacttttttcacctgacattgtatcttggagaacattccacatcagtacatatcttagctacataattattattagtggctgcagagaattccattatatggctgaaccacaatttatctgacccgtctcctactggagttgttgccagtattttgctgttacacatagtactccaatgttcatgtgttctttgttcatgtatcttcatatgcactaaatctatactggaaagaagtggaattgttgggtgaacaggaatgtgcattaaaatttttgacagttagccgggcgcagtggctcacgcctgtaatcccagcactttgggaggccgagacgggtggatcaccaggtcaggagatctagaccatcctggctaacatggtgaaaccccgtctctactaaaaatacaaaaaaattagccaggcgtggtggtgggcgcctgtagtcccagctactcaggaggctgaggcaggagaatggcgtgaacccgggaggcggagcttgcggtgagccgagatcgcgccactgcactccagcctgggcgacagagcgagactccgtctcaaaaaaaaaaaaaattttgacggttaatgccaaactgcccaccaaagaagttgtttcagttgaccctgccactagctgtatataggagtgcctattcctccatatcctctctccgcatcacagcatgtgataagccttttaaatgtgtgcttggagagcaggatgagaacctgaggtggtgggggtgggagtgtggtcagggaaggcagagattttccagttgttccccatgagtatggttgaggctctcacaatagcccagcggtggatgtagcccacaagtgttgtgtccccaagaccttaggtgtctagcagcactccaggatacccatgatccacaaacccacgtggtgcaagtcctagagtgtcaaaagagattctttgatccttactaccctctttcagcttcatgcagaaccatttctgaatctcaagccaggactaggaagcctggattggaagccagtttgctggcagaggggggcctccagcaaaatgtattttaattcactgtcaccacatgcatgcacacatgaacacacacacacacacgcaccaagaggaccaaatacagaactcaagatccaggttcagaagtgcaagcttgtgccttgtgaagcacagctcttcatagtatgagtttccaagagctgtaggttagatggcctgtttcaggttgcgagaacaaaggtgtgcttccgtttccttgggcgatgggacataagtgtaagaattaatgcataagtgaacccctccctggcagccactgctcttcacaactgatgtctcaggagtgctggacaagactgctccccacgactttgctttccccattctccatggctctgctactgctgtctccctgggcttctcctgggttctgggccacctcactgcctgtgctcctctgtatgtatctgtcacatacacgttccccaagagaggggttcttattgggtcaattggtcactccaccttctggaacattcttatcagcctgagtgctcagtgcaaagcacctcacgggcctctgggcaccctcagacccaactgaaagatggctacccttgactcaggcccaggctgtctggtgtgtccatttgtgacctaaagaacagtgcccggcacagagtagccactcaacaaaatatttactgaatgagtaaatagtgatccaagattgaggaatccctctgtcaactctgttcaggaggaggctgtgagtgagggaggcatggggaacattgttggattcctctttgatattttagacttaaggccaaattcagcaaattcattaactgcattaatacttctatctccaaagtgaagtattgagaagaacacaggctttgtaacccaacagatctgagttcaaatcctgactatcactaactgtggtgaccttgggcaagtttcttgacttctccatttccttaccaataaaatgaggcttatagtatctcccttgcagtgttgttatgaaaactagtccagacaaagaatgcaaagcacccacctcagtgcctaatgcataaagacattcaagaagtattatctgttgagaggattcgtgtcatttttcaagttaaacttcctgacttgtgtctgctaagctcctggtaaatgcaagtgtgcttgtgtttctagagataagtttggacttctcaagtcaacacacagccaggtaccacaaatatgtctacttcttgatgttcacaactaaaggaaaaagccttttatttctcttgttcaattagctttgagacaaggcaagccatctcatcaatttgctaatattgctttcaaatatttataaagtctgtctccttatgatggttctataacctgagttctaatctattctctggactgtttacccagatatattggaatttgttgccaggaaaggtggtttctctgcagatgtagaaccttggccaggtccctacatggcagtagtcaggttatctccatccaatacacaagcagttaccagtcatttcctgaatacctggccttgtgctgtgagcaacattatttcttcaatccaggagtcaaggagatggctgagaaagggcctgcttccttccaaagtccaaggtattctatagggtgggtgacccacaggttgtctgcctcaccttccattgatagatgttgaggatgcttccattttcaccttattactagcaatggagcaatgaacatccttggacttatatctgtgtgcgtgtgtgtgaatattcccctagtatagcttgcttgctttctttctttctttctttctttctttctttctttctttctttctttctttctttcttttcctttctttctttctttcaaaacctactcttctctgttgcccaggctggagtgcagtggcatgatctcagctcgctgcagcctctacctcctgggttcaagtaattctcctgcctcagccacccgagtagctgggattacaggtgtgctccaccacgcttggctaatttttgtatttttagtagagacggggtttcaccatgttggccaggctggtctgaaactcctgacctcaggtgatccacctgccttggcctcccaaaatgctgggattaccggtgtgagccaccgtgcccagccctagtatagctttatgaaagtgcagttacagcatccaacagtgtataaatagttactttaaataagtaccagaatattaccctcaaaaaggcttaagaagttacacttccaccctttacctcggttattgcactcctaggtctataccctagagaaactctgagacaggtgaatgatggcatatatgctgtgaatgttcatgatggcaaagaatggtatggacaatttgatgcaatttatacagtttaagaacatacaacccatactgtatagtttattgtttatgagcacatacatagcacatttcaaaacatgcagggggctttgactcaagctgtagtattttatttctttaggaaaaatgttctggggcaaataaagggaaatgaatttgttcctgatattttttcatatgcttgaaagagttcgtcatctaaaaaaaaaaacaagacaagaaaaaggcagggcaggttcacagcccctccagagcccacccttttgttcaagggcacctggtacatcagagagatggataacctccatgggaagagactttgcaccccaattcactaagagccccttctctcccagacatcagtataaatccttaggatctattgcttgagtaaccttatgattctcgacttccaggcccaagagaatgataaccaaatttttgcagttgtcaccctaacactgggacctgcctgcctgtccatcatggagctctaagtatacttgaaccacatgtgaggagtaattggggcaaattttagattcaaccctggatttggcaatgccctttaccatgagcccaccattgcaacgcagggtgcagtaaagcaagagcattgcaaagctctttctgaaaccagaattttgccataatgcctcctgctaacagtgttgcctgattagcagacacaatgggaccatcaggccttatcagcaccacttggtctaaaacagaaaccaggaagggctgtctctcagtgcttggcccctgttgccatggcccctgttgccatggttcccaagcacttttgcttatgatttctctcaatcgcttatagcatccatcagcaagcaggacctagaagctctttcgggcagactgagaagaaagctgtaaacaggaaagataagagcaagtaagggaagtaattaaacgagcaaacaagaaatgtagatggaaagaatttggggtgaggcccagaaaacagcttttgttatgtaaaagaaatcttcttgagatgtgatagaccaaggtgtctgggtcagaatttgccaagaagtgcccattatgtagctgccatgtggtataggtacagcaactctgtgccctggattttccagaaaagtcccagtttcaagtattttattctgtttgtcagaccaagaattctgatttgagattcagaaaataaggtcactgtagttagagtagtcatccaggaaagcctgatttagaatccattgtcctcccgggctggttggcagggaatccccacaggacttgcctctagggccctgaaggcctgagtaaagtagccccttatacagccaagaaatatcaaagtgcctctcaactccatgccctccacactcccgtagctctctgaggggtttagccagaaaggcatgggcttttgacccccatagacctggatttcaatatgctctgcattaactctgccaacataggcaatgctctgagcctcaatttcctcatctgcaaaatgagagcaataacacagggttatgacagggttattctgagcatcaaatgaagtttttgttacctttaaagcactgtacaaatgtgcactgctaaaatccattccttcattcaacaaataagtgtctactacatgccaggcatgaggccaggcctgagattacagtggtcatcaaaacagacagggttcctgctggcaccctgagctttcaggtcacaggggtagacatattagccaaagatctcctcatccgaggtccaagcagaagggagatgcagtagggctgctcttttaaaaagctgactgtggctgcttcgtagagccagagggcaggagagggggctgggaggccacttaggagacttctgcctgcaatagtggcttggtctagggtggtggcagtgctgatggtaagaaatggccagattctggacagatttggtaagtagaatcaacggaacttggtgacggactaacttttgggagtgaggaagaggcaaggagatattttagctaactgtgtccccaggacttgggccactggagcccataaagccaatcccaaggctggtgaggtacaatgtatggagggtccatttctccttatctcgcctctgtagagcagtatgatgtcagtccttcagtccagaaatcagcttgctagacttaatctgaaaaaagcatttagtacttaaaaattgtataggataatatatggcattctagctttatgttgaacgcagaattcctcttaaaggtaaattgtttgcttccaatttttaagttgttttaaaattgacaaatgtaattatttgtacatatacatggggtatacagataatgtatagtgatcagatcagggtaattagcatacccattatctcaaacatttatcatttctttgtgttgggaacattcagtatcctccttctagctatttgaaactatatattatcatttgggttttttaattctttcttcttttagagactgggtctcactgtgttgcccaggctggactcaaactcctgggctcacgcgatcgtcctgcctcagcctcccgagtagctgggactacaagcacatgccaccatgcctagaaatgatacgtgatttttaactatagtcatcctgcaatggcatagaacactagaactttttcctcctccccagctgtaattttgtataatttaacaaatctcttcctagccctccaatttttgaatgggatattactttaaaaatagctgagttaccattaacttaggatgctgaaaacgttcttcagtctaggtgatctcttctgggaccaacatatgttctttgaattggattcctttcaaaccttgggcccagtagtttttgtaccaacaggttggaagagaagagggcccaaaaggggaagaaatgggaagggccacagacaaacttaagtttcataacagttaaccacacttaaccgcagttaactatgctttacagcttccaggggaatttcacatatatcatttgttgtcatattctgcaaattcaggaccatggctgtctcctgactccccgtccagtgttcctgctactgattgcactgccaggttcttaactttttgggggagaagggggaggggaaggtctctctgtgataaacaaaaaagttccaacagacattcaaaacccttctttattctaaagaatttattccatttgcattgagaaggagtgtaaaagaaaatttggtattttcccacaccacttgtcccctacacacatcaacaggtctttcatttctcagttcttgcagacccacccttcggaagctattatctgcttgacagtctgctgagacctcttgtctttcttcctctctcaattaaactctaaggactgaggttcccatctgccctggagcaaacacatctcttgttatacctgttttccagaagctggagagcttttttcctttctccaaccgctatagttctcttttcaaaacacttaaaccctcttagtgatttttaactgcaggtggcaattaaattggtttcccaaacatggaccaaaccttctctccagtgcctcctgcatttaccctgcctccacccacccttgaaccaggaaagaaaaaaacacacagacacaatttactgagttattgtcctctcttctgtgtagccctctcttaacatgaatgtggcaaaattgctaggaagaaatggtaggatgtatttccactaggtaggtctctttctccacagcggccatctttgattattgtgtctggaatcgagcagtacccaaccaacatggtgcccttcctcaggctcttccttggcgggaagacagaggcagcagttgagcaaggggagccaacagaagtggaatggctcctcattcatagacccttgtgggttttgaaggagagaggaaagagaaggtttggaaagaataggacagaaagggaggaataagaaagaggaagttggccgggcgcggtggctcacgcctgtaatcccagcactttgggaagccgagacgggtggatcacgaggtcaggagaccgagaccatcctggctaacacggtgaaaccccgtctctactaaaaatacaaaaaaattagccgggcgtggtggcgggcgcctgtagtcccagctactcagctggctgaggcaggagaatggcgtgaacccgggagacggagcttgcagtgagcgaagattgcgccactgcaccccagcctgggtgacagagcaagactccgtctcaaaaaaaaaaaaaaaagaaagagagaagaagttgaaaggggtgtttacaagtggaggaatagaaataaagctatgaattgaataatagaaactctgatttttaaaattttattttatttattttttattttaatagttttatgttacgtaaaccattatatgttatttttaaatatatgaaaataaatatatttaatggtttgttattgtaaaatgacacgtttgttgttaaaatttcaaatagtactggagagtttcaagtgaaacatacatgtcaaaatcatctagaataacagttacttgtgtgtccttgcaaacttattccgtgcatatataagcatctgtgtgcttttgatacacaaatgagatcatacaatacatactggcccattccttgcccatttttttcaacttaccaataactctgcagttttctagtttctactcaaagagatatccttcattcttcttaatggctgcatatcatccccttgtgtagatgcaccatgatgtgtggaacccatcccttgttaatggacatttaggtaaaatagaaagtctagcaccacactatccaatagaaatataatgtgggccacaaatgccagccacttatggaattttgaattttgtcttagtagctacattcccctccccagctgatttgaaatgccacctttattatatcctaaatgctcatatatacataagtttgttttgaactattttatttcattcatctatttgccaattttggcaccagtatccccttgtgtaggaattttttttttttttttttttttgagacggagtctcactctgtcacccaggctggagtgcagtggtgcattctcggctcactgcaacctctgcctcccgggttcaagcaattctcctgcctcagcctcctgagtagctgggattacaggcccccaccaccacacctggctaattttttatttgtatttttagtagagatgggatttcaccatattggtcaggctggtctcaaactcctgaccgcatgatccacccacctcagcctcccaaagtgctgggattgcaggcgtgagccgccacgccggccaccagtatccccatttctagtagccacatttaaaaagtaaaaagaaaaaggtgaaattaattttaataatatatttaatttactccaatatatcaaaaatagtgtcttacaatgtaatcaaatattaaaaattattaatgggatactttacattctttgtttcatattcagtctttgaaatctggtgtatgttttacacatccagcacatttcagttcagactgccaatttcaagagcttaagagccacatgtggcttctggctaccgtattgaacagtggaagttgagcaggcagagagattcaaaatgtcacctgagctgtgtgtctctgtggttggtaggaatggattagaaggtcagacattgaggacaaaatcctcaacttcaccactcaaggcaactcatgaagcttctcagggtcttggtttgtggactccaataaattcaacgtatgctggttgagtgcagaccagaacagccgagccaagtacagtcaggcctcgcttcacaatggggatacgctacgagagaaatgcgtcattaggtgatttcctcattgtgcaaacatcatagagtgtacttacacagacctagatagtgtagcctgctgcacacctaggctatatggtacagcctatggctccaaggctacaaacccatacagcacgtgactgtgctgaatactacaggcagttgtaacacgatggtacttatctgtgtatctaaacataactaaacctagaaaagatagagcaaaactatggtatcatctaatggggccactgtcatatatgcagttgtcatatatgcagtccattaagcaggggtcctcaacccctgggccatggacccgtaccagtccatgacctgttaagaactgggtcacacagcaggaggtgagtggcaggcgggcgagcattaccgcctgagctccacctcctgtcagatcagcagcggcattagattctcataggagcaggaaccctactgtgagctgtgcatgtgagggatctcaattacttgctccttataagaatctaactaatgcctgatgatctgaggtggaacagtttcatcctgaatccatgcccccacccaagtccgtggagaaattgtcttccacaaaaccagtccctagtgccaaaaaggttggggactgctgtgttaacttacatgccattatgtggcatattgctgtacaaatggccctggcctttccacaagccgtagcatggccacagagatatagaaagagcctgagtgctcacgaggtgattatctgaggtctgtcacaggttcccctttctttgctttcagaggcatctctgttcacagcgtctcatcacactcaaaacccaatgcctgtttccttttttttttttttttcaaaagcagagtgtgtggcaacggggctctgaggaaatccctaccactgtggttggggagggtgtggtgtgaagaacccacattgtggcttactcaactgtgagatcttaactctgtggccccagagccactgtgctcctgggcggcagtggtgacagccatggcggcacagcttagagcctggaatggtaagcatgggctcaattgcatcctgcaagaagactcgcatcagggtttgagctcggggtttggtgtctgggtgggtgtcggcagaatgggaggaggcaggtggctggagagcactggggacaggtggagcagccagttttgccctggcctgagtcaggccaggtttgggaagcatttggactccacagcaggcttgggtgctcggcccctggattgacaggaagctgagaaatgtgattatctcccacgggacaacatgctgtccccaaacaaaggtggcggtcgcatgcccactgcctaagttctaaacgagccctcccccagccttttctccccaagctggccagctacaagacccaaccccatggtggagccgagggttcagagcagctaggcacaggagaaaggaatttcctcctgtggctgcctgggagggagctctttttcatcggccccacctgccagcttccccattaccaggccgaggagtggaacaccagcattccttttcccttcctactgctgcctcctccagccctgcagcctagaaactctcagtggtatcagactcctgaagcaccaggcaacagcccagcttctttctgcttggtcacacaagctgtggcctcccaaatcatgcctgggctaggaagacagagcagtgtcacaggaaatctaagtcccatgcacatggtgatctcaccccagcctctactgcttcagccccctcctgaggctggccaaagcgtagaagccctgctgattaagcctcttccctgaatgttggcagcctaggctctgcactaacttagcacctagtgcagagcctgtcacgtgcatgggagctacccagtagcattctcttggacggataaatgcatgggtgaattaacatgctttggatattgtctttgttgtacctcctcagggctcccaaagccttaaaactagaacttgtcacctcatcactttagaaccttctatttgcaggcatctatgcacctgctgatctctcccactaagaaaaggtgacaagagaaaccagccaggggattcctgagggtagtctaggagtctcgaagccttgcagtggtcttccaggctgaatcatcctacctcgagaaccaagagcatgagagttggcatcagacagacttagttcaagtctcaaccctgctatttcctgtatatataatcttagtcaaaagtcatttcaccactcttaagatttagtactctactctgtaaaatggggctaaaaatacctacccagcattatggtgaggaataaatgagaaaatgtgttaggttgaatcctatgaaactgtccaaagcatttaaatgccagcaaatttgtatggttcaacctaatatataaagtagcctttataaactataaagtataataaatagccctatataagtattcattattcttaacagatataatttgtaagtcacagaatattgtttcttgcagtattagtaatccctttcatcagaatacaggtcaaactaacagaagaagccacttatctgacaatcgtgggctgcaggcatttcctggagcattttggcctgggaaatagggagcaggtatttttaggaaactagactggttcatggaaagcaatggaggtgaacaccagggtgactcgtgacagctcctacctggaaatgattaacccgcaaaagcacagtaggagttggcacattctcttgccccagatgggagtacccactccctagctccagtagcaaagcagaggctgcctaggacaaacattccttcccgggggacagagccaaagggtcctaggccagcagacatctggaggaaactaaaaacagcttcttgccaacttttccctccctagtggcagctatcaagcccaggtagctcctcttgacctagcaaagtcccacgcctgggaaagcttggatttggaactgatagctgcagtggccacagtggagggagtgggggaaggttctcaccatattatgcatcgctccctcaatcccaatcctagatgtaaaggtcactgggatttcaggccagaggggactgggaagagtccagagaagtgcccacagatttgctctgcctccgttgctggcaccccaggccaaggactactgaagcactaaacaaacagttataaacttcctaagcagtgtttctcaccgagggcatcatggcccttgtgggtaagacaattcttcattgtacaggacagtcccatgcattgcagaacatttagaatctggtagcaaggtaagagtagagctggatgagtcccaggtccaaggttcaggagaaggatccaagcagagtagtggcctcttcacagctccaaatggcaccttggtgaaggcatcttcaactagatgctctacaactagcttgatggctgtgcactaccccatgagccaactgactgggtaatcttggttgggccatcagaaacatgtaaattcactcagacagggcctgggacttgagaggagaaaagccagagaagataccctcccagggctgcccatgggcaggcagtgctctgcacagctcttagccccaagccctggccagcctgtggcagaaggtccatgtggagagtgaggccgacttgacccagtgcccgagtaccagtttccagcatcagccaggatggatgtgggatgcgtgacattcattcagggaagtgtgaatatccaatttgagctacaatgtggactccccatagcacagaagtgcttgaccaggagttcatttacttaaatgagaaaaaaattataactttgtcttcattaacctgtaattgaaagttagctttccttccattatgaacacaggccacacatcacagtggcattagcctgtgactttgtctcgaacaggagccacagatgtttttatatctcattactgctgctgcaggtgccttaaattactgtcccattcacgactacttcaaaatcatggcagtcactggacccgccactagctcatgttacttaatgtgttaataacgaaatgcatattactatgttgcaaattttaagacatatatagataactttaaatgcaattgacttcctttgtaatcctatgtattttattttgtgcttgtagaaacattccaagtagaggcccataagtttcattaggctcctgatggagtccaagccattaaactgttaagaaatcctggattagagggttgtcaggaaatcggcctcatttgagtcaacaaggaaggccttgagtatgaagataaggagcatgggcatgtgttctgctcacattgaggggatgctaaaggtttctgagcaggaggttgcccaaggtgacgctgaggtctccagcctgggattcattaacagaaatacagaagtcaggaggaagagtggattaggatagcaggagaggttctattttaagtatattaaatttgagactaaaaaagtgggtatccaggtgaagatgtccaccaggctctgagaaatgcaagtgggcagactgggagagtggctgtggcaacaggaaagagttgaggatcatcctctgagatgatcttggggcgtttggagtgattgtgctcaacaaggaagaaaaggcagggagagaaaagaggccaaggcagggaattgtcataggctggcatctccaagaaacagatttggagatattgatttgcctgcaaaaggtttgttgggaactgccttctagaacagcacctgtgagggagcaggatcggtcagagacaggagttcacctgcagtgtgggcacactggagacctcagttgataacatgggaagctctggagctgagatgctcttcagatggccccagttgaggccaggcagctgggcctttcttcccccacctcccaccccaccccatctattaacgagatcttggatgcaggctgccccccaggaaaggggttgttaccttggagaagagactcaaccgtgagccatggaccaacacctctggtagctgggggactgagtgccttggtcctgaatgggggatcaagcagctcaaggtctggtgttctagtcactcaggaaatgcaactggctccctcccaccctgcaggcctctgggcaagtccctccctgcagcccaaagccaggtataggagtcccagggacagggagtcaggacctaaaaggaatttgagtccttgatgcctgtaattcagagtcctcagtctttcccccaacctctctcacttggggctaagataagtgggatgaggtaggcggaagttggagggaaccgtgccgttgtcatcttctgcacagtttgtttataagaggttaccaaactaagcaaatcagccaccatggaaacagtctctgtggctttcacatccctcccttccttctggggtgacctgcatctcaaagagggatgtcaccacagttgaggttacaggtctgctcacaaggcctgtgagctacccaggaaatgcaatactgttatagccaccaggtgaaagaaggttgggcttcatttttaaagagagaaatataaaaacttgactttcgattttgacgttcatgtccttacgccaaaaaatcaaaccaaatagcaactgaactgactacgtgtaatttcccccaaacctttgaaatttacagtagctctaggaaacttgaatccatgaggccgggcgcggtggctcacgcctgtaatcccagcactttgggaggctgaggcgggcagatcatgaggtcaggagatcgagaccatcctggctagcacagtgaaaccccgtctctactaaaaatacaaaacattagccgggcgaggtggcgggtgcctgtagtcccagctactcaggaggctgaggcaggagaatggcgtgaaccccgggggggcagagcctgcagtgagccgagatcgcgccactgcactccagcctgggcgacagcaagactctgtctaaaaaaaaaaaagaaacttgaattcattcattcattccctcattacacacacacacacacacacacatacacacacaaaggttctgagtttgcaagatgataggctgaaagaccaagtgtggcctgaagttcaggtttttttgttctgcatggtttaaaaaacgaattttccacactcagaagtgcagcttaaaaataaataaacaaataccatctcatgccagttagaatggcgatcattaaaaagtcaggaaacaacagatgctggggaggatgtggagaaataggaatgcatttacactgttggtgggagtgtaaattagttcaaccattgtggaagacagtgtggcgattcctcagggatctagaactagaaataccatttgacccagccatcccattactgggtatatacccagaggattataaatcatgctactataaagacacacacacagatatgtttattgtggcactattcacaatagcagacttgaaaccaacccaaatatccatcaatgatagactggattaagaaaatgtggcacatacacactatggaatactgtgcagccataaaaacaaatgagttcatgtcctttgcagggacatggatgaggctggaaatcatcattctcagcaaactatcacaaggacagaaaaccaaacactgcatgttctcacacataggtgggagttgaacaacgagaacacatggacacaggaagggggaacatcacacaccggggcttgtcggggggtgggggctgggggagggatagcattaggagaaatacctaatgtaaatgacgagttgatgggtgcagcaaaccaacatggcacatgtgtacctatgtaacaaacctgcacattgcacacatgtaccctagaactcagagtataataaaaaataaataaataaaattttttaaaaggccgggcgcggtggctcatgcctgtaatcctagcactttgggaggccgaggtgggtggatcacgaggtcaggagatggagaccatcctggctaacacggtgaaaccccgtctctactaaaaatacaaaaaaattaaataaataaataaataaataaacaataaataaataatgtaagttagttcccaatgcactttcttaaaaaatcttaagatctggtcccaatggatgaatcagctaatactaaggggtttggcccccttgtgggtaggcagggagttccacggttcacggcagggcccatttagcctgcttctctctttggtgttacctgcctgggccctgccagtgtttgtgctcatgagcccttgatttggctaagctgggtgctgaggttacacaatgatagatgatgtcattgctctgctctgctgtctcctctgccctcagggctcaccatctcgtggggaggacgactcatgtgcaccaacagacagaagacagagtcccgggggggtgttggaggaaggaacaacccatgaggaaaagcgaagttgggacaatgtcatagagactctaggagcaagggtagacttctactaggtggaaaagagggcaggggtgggagaacggcattctagagcaaaggaacaattcagctgatgaatggtgctcctaaaggaagtggcgcatgtgaagcggagaagaggcaggggccagaatgggaagaccctgtcagccagcctgaggaactggcattttatcctgatggttttgaggcagagggaagagctgatatgacttgtgtgtgtctagaagatgactctcttggccccgtggaggctggatcgtaagagagcaagatctgagggaggaagagcagcaggtaggaggttcttgtaattgtttaggtgagaagtaacagggctttgatttggagaggtgccagtgagtgggagaaggaacagatttgagagggagttaggaggtcagattgacaggtcttggtgattcctcaaggtggaaagtaaaaaccgggacccagtggcacagtggtgtgcagtgttatcctagccatggcagtagctgccctttgttaagggttctggagcatttgcagtacttgcccttacattaactcaccccagcctcaaagtcaaagacaccaaacttctgcctgtccacaggcttcgtgcagcacttcctaggtgccaggctgaagtgttgccttcacattcactcactgcgtcatcacaacttccctaggaagtagttactattcttacgtcattttacagatgaggaaacagaggcccatagaggcaacgtgaatctcccagggtcacacagctgataagcgacagagccaggatttgaacccacatcgtctgctccagagccttcgctctgctgcctgggggcgggaccagaagagtggtcactgagcacagagaccttctgcacacagagcagcctgagcaaactgcagcaggctagtagtgtgtgcatcccacacatttctccagtgagcatctagacgtgaaatcccgaggccttggatgggctttctagttccagaaatttgaggacatgcgggtccggcagggaagaaggaaacgctgagcccaggttgccggcactgtaggcagtgaaggagagcagtcaggtcacaccacacagttcccttccccgccccagaccatagaccctccaacagctttcaggtatgtcgagcatcaaaccccaattcctgaccgcagcccataagactctgaagtaatatggcccctgaccacctctgtgacatcttttcttgccatgctcccctcatacatcgcacatacactggctcctttcagtcatccttttccaccccagggcctttgcatttgctgtttcccctgccaagtgtgctctttttctctttgtgcggctggttccttcttatcattcagatctcctctgctttagtgtgaactccgtgagggcatggactgtgtctgtcctgttcactgttgtattccccaagcttatgggcccagtacacagaaagggctaagtatttgttgaatgaatgagctattttggtacctgctgtgtgtcaggcactttacaaacattaattcgtttaatcttcaaaacaaccctgtgaattaagtgtgattgttattcccattttatagatgaggcactgggaggtgacttgacttgcccaaggtcacagggcttaggaagaaacagagctggaactggaacttgactcttgacttatgctggcccccctaaacacattgctccaaagtgtgcattcaggcaggttttgttgttgtttgtttgtttgtttgggagacagagtctcatactgtcgcctgggattgagtgcaatggcgcgatctcggctcactgcaacctccgcctcccaggttcaagccattctcctgcctcagcctcccaagaagctgggattacaggtggcaccaccatgcctggctaatttttgtatttttagtagagacggggtttcactatgttggccaggctggtctcgaactcctgacctcatgatccgcccgcctcagcctcccaaagtgctgggattacaggcatgagccacctcacctggcccaggcagggtcttcattgagaaaggctggggctctgtccttccgtgtgctgctttatatggctaacttaaacttccccagaaaggaattgaagcaattctggtggcctctcagctggggttgttaaacaccctggttgttccaccttttcattcttatttattaaaaactccacagagttagagaagttcttcagaaagcaaagcagagttctctgctcaatgagaaagtcaccccattccagtaggagatgcagccaaaacccacaggacggggcatcaccccaaggatgccgggaacagaggggtgaagtgcttttctctggtcccatattttctccaccagcttcttagttgcctagatccttgctgctcaaagtgaggtatgaagaccagcagcagcagcagcatcacctacgagagtgttaagaaatacagaatctcagcacacacacccccgctccacctactgcgacagaacccgcgttttaacaacatccccaggggatttggtgattcatgtgcaaaaaaagtttgagaagcactggcctagaagacagcctctgagaatgacctcctcatcaccagactgggagctccctaaggacagggactgtatctcgttgtgtcctcaaggtcccctgcacagtaccagccacctagtaggtactcagtcgtgtttcttgaatgagtaaatttatgaaggaatctagtcacatacagccagcttaggcacagatagaatcatttactatgcatgtttgcaaccctttcccctgccgtgaccccctccagcaagctttccaacaaagaaacccaaccccagccccgggacactccttctagcctgtggtctcaagagggaggcccagcaacagggagttggtttctgtaggccctagactttggacaggacgctgaacggcttgtcccctccttgtttcttccatcctcccacctaaaaaaaaaaaaaaaaaaaaaaaaaaaacccaaagaggaacttctaaggtgcccacactgtttattgctctctttactgaggccatggcctcctcagcacacacggccaccacagtccctttcccacatctcaaatggccccctggaaattcgagttcctcccaaagtgcagaaggtgctgtcaggtgctggctaccaagcccttgctgcatgtggaaccaaaataaacccctgttgatatggaaacgggttgaattattttaagaaaaaaaaattgctccttcattaaatcgcgttgttatggcaaccggaattaggaaagtaacttggccatggaggttatgtgcaatgttttgggactgagaattttcagaatagtggaaaacagtttgtgagtgcatctccctgccccggactctgcctggaagaggaggatgaaggccagttgagcatctggccggccaccctacctgggtggacttgtgcagggtggctgggggctgctctcaggggccgagcctgcagtgatgcaggctgaggccataaaggtttatgtgggaaagacagctaactgggcggaggatgtccggaccagaggtccaccactgtctgggtgtgcaagtagtcctccactctgctgcaaaaagagtgtcccaaattcctggaattaaagagaggtgggaggctcaaataataataatagctactctttattgcgtctttactgtgagccaggcactgcactaagaagtactggacacactcatagcaacccagtgagacattattattatctcagttttgcaaatatagactgagtcttagctcagtgaagagacttgtccaaagtcccacagtaagtaagtataaggtaaattaaagaattgcagccatagcagcagcagcagtagcagttctgtagtagcattttagcagcagggaggggctacacaaccccttgacatactcacactcagtcctcctcagaagcaggagtggatacttgcaaagacagtaggttgaagtgagattcactcatttattcattcaacatgcatttaatgaccacttgccatgcgccaagcactgtgtatatgctggtgaccaagacagacaagatccttgacctcagggagcttacagtccaggataaggcaaacagacagtcatcaatgaaaccacttaccaagaaaagcttcaagtagtggtaagtgctatgaagaaaagtaagcagagtgatgtggctagggtgactaggatcaggacaccatagcaagatcaggggtctatctgaagaggtgatatttgagcagagacccaaatgaaggaaggaagcaagccatgtgaaaatcagggaaaagagtgttacaggcagagagaacagccagttcaaaggtcttgaagtaggaatggacctggcatgtttgaggagcagcaaaaaggcccctgtgataagaaaagagccagcaagcagggagaggcagaggccggatcattcaggccttatagatcatggtaaggactttgcattttagtcctgtgtgatgagaagcaatgggaagatgtgctggggagcaacgggatgtgatttacttctttctttactaatagctttcttgagatataactcacataccatgcaattcacctatttaatgcatacaattcagtgactcttagaatattcccagatatgcacaactgtcaccatttaattccagaccatttttattatgccaaaaaggagacctttttctcattagcagtcactttccacttttgccaacccctacctctccccagccactagtgaccactaatcaactttctgttttgatggatttgcctaatctggacatatcatagaaatggagtcatataatgtgtggccttttgttgctggcttctttcacttagtgtaatgtttacaaggttcatccatgttgtagcctggatcagaacttcattcctttttttttctttgagatgcagtctcgttctgttacccaggctggagtgcagaggtgcgatcttggcttactgcaacttccacctcctgggttcaagcgattctcctgcctcagcctccaaagtagctgggattacaggtgcgcaccaccacatccagctaatttttgtatttttaatagagacagcatttcactctgttggccaggctggtctcaaactcctgacctcaagcgatcctcccacctcagcctcccaaagttctgggattacaggcatgagctaccatgcccaaactttatttgtctttttattattgagttataagagatctttattatattctagatacaagttccttaacagatacatgattggcaaatattttctccatttctgtgggctgccttttcattttcttgatggtggcctttgaagtgctaaagttttcaactttgatgtaagttcagtttattttttcttttgttgtctgtgcttttggtgtcatatctaagaatccattgcctcatccctgagtgacttttgaggatgattcctctggttgctgtgtgggaaacagatgggaggtggggttgctcagtagctggcaagaggaggggtgccacctgccgtgaggggtgctctgtacacagcttgccgactcccctgtggaccaaatgctgaaccctgctgttgtgctagacccctattgacttcagtagggatggcaccaggttcaagaggccaaagaggagacccatagccagcaaacgagacatagggttttattagagggaacttacttacagagatgatccagtgggagcaggctggacaggagaaccacaacgtcttgcaaaaagcatgcagtttatatggcaccttcacttagcaccctcccccagcaaccgctatgtgacaaacctcatttcttaagttattgctgtcaggtgcgcctaccatacacctgcaaagtggcctggacccaggcacagacatcaacaggctggtttcgttttcctacatttctcttatgccagtcccattttctgctcctctcctggtttgaacctgattgggcaattcagacatttggaaagaggctcagagccaggtcagaaggtgatctggatggtctcttggtgcctggggaggagcccccgtctggctcagtgtggggcctgagaagaggtccttcctctttctgaccctcagtttccacatctcttctgtatgaggggctggactagggcctctgactgcccacaggcttctgagtcttcattttcccattctcatagggaggctgaacatggctggcagaaaatagttattgtggtaacgagagagagttgaagtaaaccacaaaacaatgtttacagtatgattccatctttgtttggcataggaaaatttctggaaagatatacccaaggtatcagccgtggttgcctctggtgtgtaggattatgaatgttctttccctctttctgtttgtttgtacgttctgatttttaactatgttaagcatgtttcgcttttgtaataagaacaaaaaagaaaagcataacagaaaagcatgacaatttttaaaagagagaattgcctagaagccattaggaaacaaagggagtgggaaaggtagcagcggcctcctctctggagcaggcctctgagccatgcccgagcccacgagagagcatatgtcaatgcgcctctcacactgcaaagggcccttcctgccagaggagtttggaggccccaggaagccgaccctgaggcagagattagtgtgcaggaagtttgttagggggcccttgggatcaacaactgtggaaagtgggtgaggaagcaggattatgcagagggagtaacgtaaactgcaacaaaggtcacagtcaatccaaaggggaagctctggaggtgagaaagccccacagagctgccctgagttgaggtgagggagccaccctggcaagatgtgacattggacaaagtaatccccaaagagggctaacaacaaaatgccttctggcagctcagccaacatttaagagaataagttgtttatccctgaggtggaaccttggcggcacatcacagtgtccactataagaggactgtttggcagaggtgacctccataaaggcaagccaataggcagatatgaggggaatttgggaagaggaagaactcatctttgaactcagaagcctggcttcatcttccactccgagctgtgatctccattcctgatttgtctcctcaggcagtgacctttgaagcagcgataggccaatttatgattctttaattgccctggaatgcagacagggtggaattattattggcctcattttgttaatatagaaagctaagttcagagggaacacacagcgaggtcgtgatgaggcagagtctcaaagccaggtctgtccaactccatgtcccaacttctttccctgttaacacagctgcccaaattttcaagcaatttgggttgtggtcagatggacaaatccgttcctcctcgttaacactgaaccagtttgttctccatgtccggcaatcaattttcagatgagctggtcccaatcctgcagattacaaagtcaaatttgactcagttgatgcaacctaaagggccccttactgtcctgaaaagctgctgtctttggaggaaggtagagctgcctcccaccaagaacaatcctgaacctcccgaagtttggtgggggcggggggggggtgcggggggcgtgagaggctgcagggagactgactgagttaatcctgagttaatcttattaacctatgagatcaattggctacaggcgccaggcaagtgacagcacaggcattaattcagcagcggccagggcagcctgacagccaggaactgatttatcagggcttttaatggatgggattgcatttagctaattgagtctggggctggcacggataagacaacccccttgtgatatgcaactgctcagtggatgtcctgccattgtggggggaagggtgacagaaggaaataagaaagcacatgacaaggaatgctcccttcctggccactgtaagggctggtgttgggttccaggtatctctaacatgtgagccactagtgtagtgtagggcagtgattctcaaaatatgatctttgcaccagcagtatcccttgggaacttgttagaaatgtaaattcctgggccttccccaggacattcaaactcctagacagtttgaatgtctaggagtggggcccagcaattcgtgttttatcaggctgtccaaagaattctgatgcacacactcaagcttgagaccccctagaggagttatgagtgcaaactctagtaccaggcagcctgggttatagtaactgtgatgtcggacaagccatctaacctctcagtgtctcaatttcttcatctgtaaaatgagggaaataatagtacctgcttcatagggctgtcatgaagattaaatttgtcaagtgcctagagcaatgcctgtagtaagggctatatatatataaatgttaacaactgttatcgttggaaataatggagcctgggacttctgtctgctcccttagtatgacagtaattctaactggatcataaagtttcctgtgatttgataagtaaaaaaatatggcacaaaattttatcttcactgcgattgtacttatgtaaaaatacttatgcacataaacaaggtgaaattatggatggtttctttctctaatcacaaacctttgaaatgtggttaaatataatagatctttgagatccaaatattaaataaattcagatggacaagaaaaacatattgaatcacaagataagcaatggacagagttgaagtagaggctactatagaggactcatgataaaggactgcgtgcgtgggtccccactccactcaggggcaggggcgtggttctgggctcatcaggttacactggagaaaatcaagctcaagtttcctcaaggttagaagggaggagacgtgagcaagagtgtggtccacctgaggatgcttaataacagtagcaaggatggctggccccagtgaggacagctagggggtgctcatggggtctccctcatcctcagggagggagaaagaatccagctaagaaccagggtggtcttggaagctgagaaacttggctagctgttatgggaaagtctgactattttttgagagtgccaactaaatctccatctataaaggataagtacaactagtcagtaggtttttatctccattttgccacctacatatctataggtaccagggtcttacagattgggctgtgaaatcctggcatagggccaggagagctgatttcaagatcaagacccaggtcagatgattggggtgggcatgtggtgagcttgaaacttcacataggcatgctactctcagccctattttcccctttaaactagaacaaagacactctagtaagagtttactgaggtctgagtatggggcttgtctctatagtatatatctttgcatcccagtaaccagtttacttttaaatggtagcatatctgttgatacatagtcactataggatctagtatgatgcactagaatttctgcagtttatcacagctgccctgatcacattttgtggccattcttttgatgcttgagtatgatattgtggtatgtttctgacttaccaaggttcttttctgataacaactttattaagacataaaacatgtgcaaaccacacaattcatccatttgaagcatacaattcactgggttttaatatatccagagttgcacagccatcaccacaatccattttagaacaatttttcatcccagagagaaactctacccattatcagtcactccccatttcccctcaatcgcctccccagccctaggcaaccactaatcgactttgtgtcttaatggatctgtctattctggacatgccataggatcaaatcactgactatgtggccttttgtgactggcttctttcacataacatgatgtttcaaggtccatccatgttatagcatgcgtcagtacttcattcctttctgtgactggataattccattgtatggatagaccacatttttatttatttatttatttatttatttatttatttatttatccattcaccagttgatgaacattttgactgcttccacttgttgggtatggtgaataatgcagctatgaacattcatgttcaagtttttgtgtggacatatgtttccaattctcttgggtacatgcctaggagtggaagtgctgggccaaatggtaactctgtgtttaacattttgaggaactgccagactgttttccaaagtggatgcatcacattacattcccatcagcaatgtattaacacaagggtaccacttcctccacatccgcaccaacatttgtttgacttttttattatagccatcctagtgggtgtgaagtgggatatcattatggtttttattagcatttccctaataactaatgatgtcgagcatcttttcatgtgcttgttggccatttgtatatagtactatcttttgagaaatgtctgttcagatcctttgcccatttttgatttggattattatttgtctttctcctttgatttgtaagatatttttatatgttcggacacaagtctcttatcaaacatatgatgtgcaaatattttctcttattttgtaggctgccttttcgcttttttcttgagatagagtctctgtcacccaggctggagtgcagtgggaccatcatggctcaccgtagcctcgaactcttgggctcaagcaatcctctgcctcagcctcccaagtagctggtactacaggtgcacatcaccatgcccagttaattttgtcttcctcttgtagagacagggtcttgctatgttgatcaggctggtttcagattcctggcctcgagtgatcctcccatgtcagcctcccaaagtgttaggattacaggcatgagccaccgtgcctggtttctttacactttcttgatggcattatttgtgaacaaaagtttttaattttgatgaagtcaaatttgtgtttttctcttatgttatttgtgctactaatgtcatatctaagaaaccactgcctaatctaaggccttaaagatttatacctgtgtttccttctatgttttatagttttagccattacatgtgggtctttgacccattttgagtttaattttgtctatatatgagaatgaattccaacttcattctttggcatttggatattcagttgtcccagcgccacttactgaaaagattattcttttcagcattgaatggaattggcacccttgtcaaaaatccatcagccatatatgtatggatttatttcaggactctcaatttctttccactatatggatctatatgtctatccttatgttagcaacacactattttgattactatagcattgtataaagtttgacattgggaattgtgagtcctccaactctgttctttttaaagattgctttgactgttctgggtccccttaatttccatatggattttaggatcaggtggtcaatttctacaaagaaattggaattttgatagggattgcattgaatctgtagatcaatttgaggaatattgccatcttaacaatattaagtattttgatccatgaacatgtctttccatttgtttccacctttaattttgtatcatgtttcatagtttttagcatacaagtttcacgccatgtttgttaaatttattgttatgtgttttattcttttgatgatattgtaaatggaattgttttcttaatttcattgcaggttgttcattgcaagtatacagaaatataatttttaaattgatttcatggccttgcaaccatgttgaacacaattattagttttaatagttttttagtggattccttaggattttctatgtacaagattatgtcatctctgcaaatatgggttacttctcccttctaatccatatgccttttatttctctttcttgtctgactgttctagctagaacctccagtataatgttgaacagaagtagggaaagtggatacccttgtcttgttcctgatcttaggggaaaagcatccagtatttcacctttaattgtgatgctgttgttggttttttatagacgccctttgtcaggtgatggaagttcccttctattcctagtttgttgagggtttttatcatgaaagagtgttggattttatcaaatcatttttagtctatcgatatggtgtattacattaattgattttcagatgttaaaacaatcttgcattcctgggataaatcccacttggtcatcgtgtatgatcctttttatatgttgttggatttggtttgctaatattttgttggggatttttgcatctatactcataagagatattggtctgtagttttttcgtgatgtttttgtcagtttgggtatcagggtaatacaggcctcatagaatgagttgagaagtattacctcctctatatagcttgtgaagaatgggcattaattcttctttaaatgtttggaagaattcaccaatgaagtcatttatgtctgggcttttctttgtcagcagttttgattactactaattcaacctctttgcttgttatttgtttatttggggttttgatttcttgtccagccatcttcaatagtttgtgtctttctaggaatttaagcatttcatctaagttgtctaatttagtgtcatacagttgttcatagtattcctttataatcccttttgtttctgtaagggtgattataatgtcccctcatttacttctgatttttgtaattggggtcttctctctttgatttttggtcaatctagctaaccaaatttcttttgaattcccgtttggccctccgcctccttctgcctatacttgagagccttggccaacctaagaacatacatatatgtcttttacagtcaagaaaatgagtcttttctacactcctgcatgtggagctctcagcctgaacctccaaagcatattgttatgtctcctcagctaactgaggcagattcattctgaaccagcttctttattagccagtggctatggtgcatgaggctgtcaaaattctaccctctcactgtggaaattaagctgcagcccttttagtatatggccaccagccaagtgttgctcatttgtgactaaatatgagggcctggggaagagcagaaggcagcaggccctggccagccaggacccccacgcaaggcattgtggatacgcctggggcctgctcttcgtgagtgccactcgctttgagtcttgaatgggaacagaggcaagttagaaaagcagaggcctactgctgtttgggccatatgtctccttggtcacggcacccaggactgtgcttctctatttggcagggactcagctgacagacggtaaagtcaggaagtcaggaaaaagaattggggattttgggcaagtgctaattctggctagtgttttggggtccctggcccagttggtcatctttccccttccctctgcaagccctaagcctggctagggtgctagtgtggaaacattcattagttctgaagatgtcttagagccacatgtccacttaaagattatttccagactaatgaaaaatctgtgtgtgcaagcaggtccccattttaaaatggagcaaagcccaccaacatttccatggtaaggaaatggcaacaaatcaactctttgggatgagtatgtagtgagcttgaaactcaaaccaagtgtgaccgcctcagccccaccctgggctgctgactcaggaccaagaggaagagggagctgccagacttcacaatttctgtaaacagttcttgaaaaagaaaccacacacttgtctttctgccagcccccagcttgtccccgtagctgacagcgctgccattgtcttttctctgacaccctagggcagggcttcttaacttgagctccatggacctccaaggggtgtgtggagagaatttagagggtctacaaacttggatgggaagattagttgatcttttctccatgaacctcaaacaacaatttagcattttctcaaattaggaatgtaagtgacaaaccacagtagtgttagcggtatctgtgactttatcaccaacagaaatcacaaatattttcatatcacattactgttgttgtaagtatctcaaaaaatcatttgtgttcatcaccacttcaacatttctaatctatagaattgccactaaatcttgtgatttagcgcattatgaaagtagtaacacaactagatcacaaaatttaaaaaatatttttctaaccatttcggtatgattgtttgcctttgtgattctatgtattttattttatgcacgtgaaaacattattctgagaaggaatccggaggtttcaccaaactaccaaaagcgtccattacctaaaaaaagaccaagaccctgccctggatcttggaactctcctgctccatgggcctcacttctgatccacagaactttgcctatcttactggaggggtcaaaagcacttgcatgttagtgctgtgacactggtcaggagaaactttctgtgcctagtttcttaatctgcaaaaggcagaacaataacactacctaccttatagggttgtgatgattcaatgggttaagaaatgtaaaccacttaatgcccaatacacggtaagcactattagctatttttgttgttattgctggtttatatcaatcatctcattaatatatgctattattatctcaattttcagaaaaaggaaactggggcttagaaaagtgaaattactaagtcaagggaacacagcaagggagtggcagagccagggttcaaagccaggtctatgtgactctcaagcccagtggaggtcactctttagcacactactgagaggaggtgatgtccctcagagaaatggaagccatcaacagggtgctcgctgggaaggagcaactctgcaagttcctgctttgtctcccctgctttccctactgtccacacctccaaccttatctggggggctcctagctccacgtgcataccatcagtcctcagtcaggtctcagggggccagtcctctttccaaaggccattgccaatgcagccttcatctgcaaagaggacaagtccatgttctcccactgaaccacagtcttgcagtaacaaattcactttggagtcatggaccagcctctgctcccaagtagatctcaagcctcacaggccagtggggtcggggttagagggcctgaggggaactcagaagggcaggggcttgtctggggagtggaggcagtttcgcggaggaagtggtcttggaactgaggagaacattgccagttggagtgaggccaggaatgttcatgaatttttaagggaaagggaatggagtgtgcaaaggcccagaggcatgcaagggcctcgtatgtacagaaaagcaggaagtaattcaagatgtctgaaatttgggctaagtagaagaggaaagaaggatagcataggcagatgagatggcatagataattaatgagcagatagggaagaaaatgccaaaagcaggtctacaagtcttcccacgaggaaggagagccattgaggggttttgtagaggagcagcaaggccaggtgtgtgaattcaaaggcccacggcccccacccccaggcatgttgaaggtggacctattagaacaggtagagactagagcctgcttcagtagctcaggtgagagaggaggaagggctgaactgtgggtggagaggtcatcaatttggggacactctttctggcaagcctcacagccaacaggcctcatctgtatgatgcaagaggtgaaggagaccacagtcgctggaggcacccgcccttctctagcttggtcatgtgaggagatcctacaaggcaaggcttccccaggccgtgggaccttcgccatgagttcacctgctgacatcttcccttttagcctctttctcacccgaacagcccactgcaagagcagaataaaaagcctgggccctactttcccacacaaacacaccacccccaccccccatcaggagagttgctgaggcgaggggccccgctctaccccatgtgtggcaggcaggaaggggagaggggacacagggagcaggtcagggcctgctctctgtcaaaggaaatatccaccctcctaagcctttaagaaactgttttcttccaagtaggtcccgctgttaccagggcaaccgagagccctggtatttgtgtttctgtctttggagtccctggggagaagtggcctgccgagctttccctagtctgggcaggatacaggaagtgctggccggaggtggagcccactccccacctcccattaagggggtggtctcttgcctgattaatgcctgtccttatcccctggaagagtccacccccaccctcaggagccacttctggcggtcaagggcacaggctttggctcctatggacctggtttctcgggggcagaattctgcacctaccttgtggcacatctctctcaaatgggtgtcacctgctgtctgaggcaggtatccaggaggggcaagctcacatcagaccatggtacctgctgagggatcgtcacgcatgctatgtttcttgatcacttactttgtgctagaactggatctgtgggtcggttcttgctccagggagctctaggggaaggctcagaaccaaactggccattaaatgtcacacgggctagttagttcccaaagctctatgctgctctaggctgggctgtgttggatgttagaattgcctagggagctttctagatgtagacattcctggagattttgtttccaacggcgtgggtgcaggtggggagtagaggttaagagcatgggctctggatgtcaaactgctggggttcacagtcaaactcggcaaacagggcaagtgacctcaagccacttgcctgattggtttcctcacttacagaatgaacgtggggaagtcacagctgtttcacaggcagcaagattttccttgccttcctccatcgctcagcccaggagagggtttttaggaccctcgccatccttgtcacccttctactgtcttccttccttccttccttccttttattctgatgttttcttactcctggcaagccaaagggcttctgtgaggtgcaactttgtccccttccacagggcagccagggccccaggtgggccctgcccatctcaaggatttcacattgctattgcagcagcccaggaaagcattggcgcatctgacagccaggtcagtctgtgattctgaccgatctcctgtcaattcacatcctcagattttcattttcacaagcttcttctaagccacatctcccccacttaggcttctgcagttgcttttctgaacctgactgcaggatctcagatgagcccctagtaaaggtcatttcagtgcatccttccaggttagggagagttttttggcccctcattcccttttagaggacattagaggacatcttctagtcctccaagctttgtaccacctgcagatgcccttagcaggctgcctctaggtctccatccagtggcccatttattcactcacttcttcatttatgtaccaaactaggattgagattctactgtgtaccaagtagtgtgctgggccccagggactcaacagtgactagacagatcaagaagccatggcccgagaggggatgagactcatgccagagcccatatagagtcagcagcaaggctggactggaatccagggttcttttccccattcccacagtgcttcctgcttcagggttggggcaaggctgactctgtttgtctttttttccaccttctctggccataacacaatctgggctcacctatcactacttgtgatgtcataagaaatcccctgggtgctggagaccttgtcaggcaccctgaagagtactggggagtcctagtgctcactgatgaagcccacgaccccataaccctgttcctccctagaaggggcagtcaaccacatacttagaactgccacctggctggttcccccagagcttccagagatggtgcacctgatgcgtgcttcgttgctttggcaaagacccagaatccaggcaggttgagacttcaagcttgtcaggagtctctcctgggagatagcaagcacggtgtatttgagttaagaatgtatatgggtttgggagtcacgaagacctggagtcccccatatgacctaatatctctgagattcaggtccctcagctctaaaaggagacagcatcacctgcctcacttaattgtggagatgaaatgatgttggcgaaagtccctggcacatggtcagaaataccatggtttcctccctccctcccttcctcttaaagggacaaagcaaatgtgcctctgaaaccagggtttgtttcccccacgggaatcctgcaagctggaggcagggggggtaggacagggcagaactaggagaccagcctggcctgttagacagcagggccagcggagtgggggcagagaggtgctaagtgtccccagagctaatgggcagctgcagggctgtgacagagccactcactagctgtcaaccttgggccagtgacttctctctaagcctcagtgtcctcatctttaagatgagggtaagggtagttagttctttccccccaggatatcattatcagaatgaaataagataacagatgtgaagtgcctggcacagcactcaaaagcagcagaggcttaatgaatgttcccacccacttcccctggaaaaaaaaaaaagtccaattcatgctgggaaacttgggcaaatcccagaatgggattcagtttcttctgaccccacagtccgtgaggagccatgagatcttgcttggagggcctcttacatggactgctctggggacttgtgattcatcaccagctaactcactggtatcccatagcgccacctagtgccaaaaagcggaagggccctccccagccaacctggcctctttctcttccttcactcaaagtcccatgcatgcccgtgcgtgcctgtagggctgggccacccatagtccccgggagaacgaatgctatttttcaagatgcccagtgcttccacttccctcccaacaatttcttccatccacaaatgcacagaactgtagacaggtcccttgagcctcaccggcccttggtttccttgtctaaggatttcaagacttcagggtagggttgactccggcaggggaccttggaagtaccctatgcctactctgtacccatctatgcttgctcaataacaaagaggcacaatctttacacaccctttatatttttattgaggagagaaagctttagcatacagagcagcttcttatcttcacaacacagtaatgcaacaataacacatgtattccaaaagggtttcctcccgagcctctgggagaccttgggctgccttcatacccctgcatgcatcccctccccccacccctctttcaacccaagaaagctcccaaagcccacagttcctcttacagctcttatggctgttacatcacaacaaatattgaagatctgggaaaggaaggaagagggtcaaagggaagcccaagcccctcctgccccagagggtggaaaccagctcactgctcatctgctctatccctggctgtagctctgagggttcagggtgagaagcaccatgggaacaggcaggacctgtgctgaagggtccctggaagtgtgggtttaaggcacccgtccttcacacttctccacagggacatggggcagcagggccagagtgttgaccatcagcaaacagggtccactgcctcgaagaatagcaggtcccctcgaagaatagcaggtccccttctggaatgcactcttgaggaaatcagataaaatcagctgaaaaacagacaaaattttctttacaaagttgtttactcctgccctggtggggatggggaaaaccagacaattgaaaggtccaacaaattaggagaatgcttaaatgaattattcagtatgcatgactgcacaggtggcagccattttaaatcctgctgatcaagaactggcagggtgatctcagctttgacaagacatagcaagaacacactagaaaggaaagcagcaaagtgttaatagtgcttgcctctgtgtggtgggactctgaatggctggggggtttttgtcctcatagttttctctattttccaaactttctttaatgattatgtattacttttctctttggagagaggggatctttttaaaaggtagcaacaggttataggaatccaaatccactgatccccaggctgagaaacaaaagcgctaatgaaaagggcatcttacctcccactgatgaatagagacctcaccagaaaccagtcagaggactgggtttctctgcgactcctcttcctccagcttttttctcttgcctccaggcccaagatcctaaggtccgcctgagattatcggtcagactcccatgaggaacagaggttgaatttactatgctttcttccctttggccacaaaccctggctgcacttgctctgctgccagtcactgtgcagaaagtccagtgtccaggggcagttcaggccagcagtggatttggctggcattttatggccaaaactgacatagtaagtgtgtgtttttcactgcagaagcagtgctttctggactcaaggcaagcagtgggtctctttataagggcacctgagtttgtacctagaagtcccaggagttcctaggaggcagccaccctcttaagctttactgtgtcactgaagcacagcagcaggccaggggttggcccccatgaggggtcccagctgtgaggccacggtaggtgcagccttcctctctcctctcagaactaagggttccttgaaattgaagggagctcagagcaggccatgggccctctctctgtctgtcccagaaggaatggccaatcaggcctcctctgcaactccaaggatagaaagtgtcctgcaaagacctttgactgggggctgcagtccaaggcctggcaaggggagaagaccaccatccctaaggaaagagtcactctttacaatggcagaatgatcgttgctgcttctttctcctcctcctcttcttcctccttctcctctccggaaccctaactggctaccctttaggcaacatcaaggaaagttgtggagcctgcaatgttgggcgctgtccaccgggggtgcccaggagggcaatgtggtgagaggaaagggctccagatgtgtggcaagtcagtccaagagccctgatacaggaatctgtgcaaaggtaaactcaagtgctgtaagtggaaccagcctgcacagtcagtcaagggcaaatctccgtcaagttgtccatttgacatgtggctttgcacactctcactgggctagatgtcgggtcctcttccaggccctctgctggaggtgtggcatgaaatgagtgtaggattctagggacatttctggataccatcctgctcaccatcgattatatctagcaactggcctcagtggctttaggagttcagggtagcctgtcctcttgctcattggggcagatcagtgaggcattgggtgaagtcctggtgggtcagtcagagaataaaactgtagaacatagggtgaagaaacgcaggagaggtgagggttaggaacaaccagaggggaaatacaagagggtgaccagttcatttatgggaacaggcccagaaacttgctctccagctcgtggccggactgagcagagtacatgccaagagggcagctattgctgatccctcctttcccaggtggccctggttgggcacacgtcgctctctggtcacggttgcaagatggtctggaattctgcaggtcttcttcaggttctgcaggtctgaaactccctgaagtcctggtcagcaaatggggcaggtatggcagcaatagcaggggcgggggatgcaaaagaagggtgtgttctgggtggccatctggccccagcactcaaactcgaattcggccacgagcagctcggtggcccccctgtctcggagtgaggcggaaaagcacaggggggcgtcttcgaacttggcgttgtcctaaacgacctgtgcggcgaatcagttggggggagctgtagaatggtgaattggtgcctggaaggccttccagaagtgggactcgattctggttcctccgtctgctaggctgtattatgggaggtgatgcacccaggaagttttcggcgtggtaaccacttgtggggccagaagtctgggatgacgcgtgaacaaaggtcggctccatctccatcagctcatctaggtcatcatcttgggcctcatccagtggctcctcctccacctcaccataggtctcctcagtccctggatcctgctgtggctctccttctggtttctggcccccatcctcatcttcatcttcttcatccttactctctccttcctcctcattcttgttccttatctcctcctcctcctctttctgtttcatttcctcttcctcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgtgttcagataacaaaggacttgccacacagaaaaagagtcgatgtgctctgtgttgctaccatggcagaattaggaccagtgggtggaaacccagaaggaggcacattccacctccagataaggaagaactttctgacacacctgacagccccaactgtccgtggaagaaatgagctgccttgggagggagggagctccccttccctgcaggtgtgtgcgctgaggctgaagaaacacctagaagggctgctgaggagggagtctgggcacagaatgaggcgttggaccaaagaaccccaagagcaaccccaaatctctgtgattctgagtctttgttcagtgtacatacagcatgaatgtcccttctctactctcactttcttcatgtattctcatcaaattcatcacttcaatcaaccctattcaaatcttgtgcatccttactcactgatgatgccgctgaacttctgcctcttttatgctgttacctcctccttccctctccttcaccttagccctcctagacctgacatcacttacagcgggactaaggtgcagggaacacggcccacaaaggctcaagtaaaagttcttgacatccaagaaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttcgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccacccccaacccaaggccccagtctgccaggcgtctggagtttatattgatggtgagttgcctcatcccccacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccatcaccttctctcccaacagcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtagagttgcttagcaccgcctttgtcttcttcccttcatgcctctacagaccatcctctttgatgcactgggtattgggggagggaagtgagactttctttgctaccggctcaccttgcgctgtcacggtcatggctcttgccagggaacggaggcatgcagaagagggggcgctggctgctctttcttcaccccctcctggcactgccaccctaactgagaccatttgatagcaagcaaaattttcttaacagaaagctccaaagccttatgaacttctgtgctcttcagagcacttatggaaacttaaagtttgtgagttctgtttgggtcagggcaagacaacttcttgtgcccagagctgggtttggagtacactgataagagtcggagcaggagagtggggtttggagtgctggtggtaacaagggaggagtacacctgggcacagaccaaaggcctggtagcactttcactggacactagtcttctagcaaggtgggcttcttcaacttgtttggcaagttttcaagaaaagaagtggtagaaaggtcctaaggccaaaaagaccaaaaggggacccagtacaattttaagagtggggaacgtgctgtattatatgtagcccagctggctgtggctctgggggcatgtggcacactataccatgctcactattaatccatgatctacactccatcagctgtaaggggaagagaaggagggccagtcatttgagaaggagatagggccagcgacatgatgaaaccatgatctcagtaacctaaagggatcagaggggtcctgtgagccagcgccagcctgtgctctgctgggaaatgttgatgaagatgatgaggacagctctggccacatgtggcaatgctccctggatatggggtcctccactgtcactggcatcatttcagaaaatcagaggcaggaaatacagcccacagcctagggaaatataccaaaaggagtgagggctgatgaggaaagactccagaagtgatgttgaacattttgtgtctaaatgtctatcttggccaggcacagtggctcacgcctgtaattccagcactttgggaggctgaggtgggtggatcctttgagctcaggaattcaagaccagcttgggcaacatggtgaaaccccatctctaccaaaaatacaaaaaaatagccaggcgtggtggcgcacacctgtggccctagctactcgggaggctgagatgtgaggattgcttgaccccaggagtcagagattgcagtgagccgagatcacaccactgcactccagcctgggtgacagtgagactttgtctctaaataaataaataaatgtctgtcttcctctcaatgaggctgtccctgagcattgcccacagagccacttgctgaggtgtctgtgaacgtgtgcagctgtgtggctggctgaatgagagaaagggagggggaatcacagacctcgccccaccaccctgccttgccttgactctgacccagccatttcccagcacccaaagactgacctagcactttaagagaaatacagctctaaaaaatttttttaataatattaagtaaggcatattattgaggaaatattccattttaattgtgttgaatttgaaaacattatcaagtcagtaaacaaactgaattaacagatattttgaaagtaccatgtaactcagatgaagtgataactataatctgtgtcaataattttcctaaattgaaaagccagtgccaggaaaaaaagagagagagagaaagagaaagaaatagagctcaatcaccatgctgtgagccagctttggtaaaatgtgaccaggtgactgtaggacagactatcaggcatcttcctggatggtggagggcagtagggcagcctcttggagacactggcctcacctggcccatataaaggccttctctgagaaaagatcacagtcaagcagcatctagtcccagtccgctgctctacaccagtggttctcacccctggctgtacctctgaataatcacttgaagacttctagaaaatgcttctacctgagccctactcccagagatttcagtgttctggggtaaggtccaggtgttgcagtttcaaaagctgcccagttgagtttaatatgtagcccagggttgaaaaccactgccccaggccacctaaaacttacaggcaacctgggtgcagcctgggaaacccagcatgcattcccagggccaagttgggaaggatgaggaagaagtgccacctgccttggatgctattcatgcttatcacgactgccatcattctcttctctcaggccaatttccaccgtgctttaaacagaaaccaggatgcacccaagtgtctttattttggctacagggcagcagtttgataaacatgcaagtttgcgacactcgttgtttaacacagagacagccgtgaaccccaagtccaccctgaggcggaggcggaccattattggattctctaacttttcccagcgagaccaaggtgaccccaccacagctgattccccagtcccttccccttacccactcctgccaatcctgccacccaggtggtactgtggtgatggggaacaggaataattgggtggaggagggggcctccggatgtcctgaaaaagccaatatggtaattaagaatagctaagggcctcttgtcaagggtggcaactgaatatggagagtaggtcttccgggctaatgaatccattacattattgtttcccattataaatgtaatacaaccagatatgccaaatttaggcaaatagatgaagagagagggttcctcaccatcatcttaacagaaccattactaccattaagtgaatgctggccaggagcacagaccagggagatagcagagggtaagagccctggtctttccgcttactaaccaggagaccttggccaagtgacataacctctctgagcctcagcttcttcatctataaagtggggataatgatactgacatggtggaattagcatgaagattagcgttattgtatgtaacttgcctaccatgtgcctggtacatagtcagtgtccaataaatggtggctattgttacaaattctcatagcagtagtagttataataataataataatgacatgacagtattaattgtttgtgtgtatgagaaaacctttggggatttggaacatccaaacggtttcctcacatccgtagattatcctcagcctcttatgttgcaaagcctaaaagtgatgggtgcgaacaatgcaaccagactcttagctttgcatcttgggcatgctccagagtcattgctggagccaaacgtcacaccatgccgtccttagttcggaagcctctactctcatctctagatggatgaatgctgaggtctgtgatggtttcatgagcctggggtgaaagtatggggaaaatgcaaggtaatcccacgtgacacttcagctctaagaggaataatcaaagctggaaagtatttggcagccatctggaccattcaagggcaccgtatgtctcactgtggggtgatgggcaaggacccaatttccccagcatcttcatccatggaagggaagaaccaaggaattctgaccaagctgttggcaaatgcttcttggcaaaaagttggtgctcctgtctcaaaacagctggtgggagatcccttgctgtagcactcatgtcctgtgtttatttcctccaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcctctttttgtgccttccggaggaaagggagctcactttcttgggtggtttgagttctttggctcttcctggaaccataaacataatacataatgcttctcatcctttctttttctgtctctttttgttttaattgtggtaaagtacccataacatttaccatcttgaccatttttaagtgtgcagttcattcgtgttaagcacattcacattgttaagcaaccaatctcccgaactcctttcatcttgcaaaactgaaactctgtacccagtaaacaacaactcctccttctccctccccgcagattcctccctccaaccaccattctactttctgtctctatgaatttgactctagacacctcatataagtggaatcatacagtatttgtctttttgtgactggcttattccactaagcttaatgttgtcagggttcatccatgtttctcattcttttctgaacccttaacaccaaaaatcaaaatctcatggccttctatatgcaaatttggactttcaatatgagtcaattatgactaagtcaagtaaataaatcaaagccccaggtagttgtagaaaacacttcctcagactccacaggctcccctctgagattcaaataggttccactctcacccactgggtgggagtcactagtttagatcactcccagctccttcatttggagaaatgatatacagtgtttaaaacaagagaatgctcgggccacctgttataatgacaaagacatgacagaatagggacccacgctgatcttcaccactcactccaccttgggcaaatcattaagcttctgaacttcatattcctcctctgcaaaatggaggtattaaaaatctccaccctgctgccctcacagagttgctttcaccatcaaatgaaataacatatgagaatgtgctttgtcctatctactgtggtcaaagtcattccttttggttttttatgtctagggagttctgtggaaccaggcaccgaagaaaaaagtttaatcagtgataaaacagctgaatggattgcagaggatgatgatgacgtgtttgtggcttcacgcacaactgaagatttatttactgtgatacacaggtctgcaccaatttccttaattctaattgcaattgccttccctttttgtacttaaagaaaacctgctattccacattgaaatcctaattgtaaaagaaaaagaaaaaaattaaaaataagaaaaactgctacctttaagcagccattagaattgcacctggaggctaagttcagatacccacatatgtgagcgcagtccagggcctcgcatctcaaattcactgacatcgttgggtaaagtggaggaagggaggggagaggaggaccaggtgccgagtgagaggcccctcgtctcctagcaaccacttggcctattgtggctccatctgctctctcttagctctgtctatagtcagagacatttaacccttcacagaattccttgtatcaaaaaaatcccatcaagagttgaagtggggcaccaggcagcatatcaaaacaggaacttaggaaaagaggaaccagatggggaccagttattggacagggttacaaggcaggggttcagtgacaagaaaactgggaagagtttattattggagctagaccaccagtccagaacaggatcagtccccaggctgtcctgattcagagtcactgagctactagccttgactcctgaaattcgtccttggtcccagaacctgggcaggactgaggctacaggcacaggacaagtgactccagctgggggcattgaaaggaatatggggacgggagggcccaacaagggactctgaggatttagaggtgagagagagagaaagcaggtcaatacggctgcttgcagggctgccgcctggattgtgtcacaggcatgggggtctgtgaagcactggtaaatgtctgctgcattaactcactcagaccaaactttctcttatctaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaagccctgggctcaacaagcagggtttacttactaaacttgagtagagaagggggaagagaaagggtctttaaacagaaccatgggaacaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatca

SEQ ID NO: 1099 - DNA, 242420 bp, mus musculus; identical to SEQ ID NO: 1098

SEQ ID NO: 1100 - DNA, 242420 bp, mus musculus; identical to SEQ ID NO: 1098

SEQ ID NO: 1101 - DNA, 99973 bp, mus musculus
gtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaaataaatgaacattgtcatgtcttgcccttttttcttccctatgcgttttcctcctaggattcccactcccttactgaccattttgctgggggtcagcattttaccctgcatatcctccatctgtctggattgccctcagattcttcctctagctatttattttgaccatggggcaggagaaacctgggaaggtgggaggaaggttggaaagcaacatggccagagtgaatgacagctgacaggccagcagtatatagcctccctgcagtgacaacttggctgccactgactgagtagtggcaagtcagactggcctatagcctgcaggctgggctggggccctgagaagcagcaggggaggacagagagaggaggagcgagatagaggaggagaaagtggatgctgaagaagttgaaggtgcttctctacacaatcacaatcatgggtcatgcccccaccatcttcaaggttacaggggtggactgggctaggctagttgcctcgcaacatcccacccactccactgaaggctgttctttggtaacatgaacccctttgagactgccctaaaagctcttgtaactggtatggtgtgggagatggggatggaaggaggagacggtagaccacaggactgccgaaggcccctgtggttgtggatctgtggcagttgccacaccctaggcatggccctgcctataagttgaggttttccccacatctggttttgaatgtgtcctgttttatggcatctgtggcctgtacactgggttcttcatctaaaaaatggtgtagtcaaagccattgggaaatagctccatgcctgccaccatatgctgagtcaatctaagctttccaacttctcccttggagatctatataatgtttgtaggtgcttagatgataattacaaaagcaatcaggccatccgcgtagggatataatatctcctttgccatcaaggaagtcactgaagggctagataattctaggtatgtttaataacactggaaaactatcatgttacactagctcatgaacttgctgtgggaaagatgttctgttgcttcttacaattattttggcttgaatacagccagttgggtccgtggtgaaaactccctcttcatctttatgtaaaattcctacttcttgattttccaactttatggcaactctggctccaaatcagaaaggacagctggtttatttgtgtttaaatcataattccagtgtgaggatagactgttgtaaatctatacggagatgaaaaaatgaaaaaagcacctccagactgcaatgagtttgccattagatgaggtgttgtggaccctgagtctgaccgtccttgctaatgaagagaagagatggcctcttgagtcagatggagtggggagggtggcaggaatttggggacttggaacaggcactcagccagggcttactttgtctctgtggtacgtttcatcccgaggctcttgggacagagggttgacagagtatggagggagaagcaaacccattttcttttctcttcccaccccaccctgctttccattttctttttaaataccatgaaattcctggtctgcttcatggtatttccatgtgttgaaaacatcttccctggagatttggataccaaaatgtccactagaatttcttccactttagaaacaagacatttaatcttctcttttttaagacacatgaatagctaaagtgataaaagtgtcaggatgttggaatagtagagtaataggagaagattcaagttatggctcttgggctcaaccttgaccttgacgacattgattaggttttaggaggagagtggtatatttacatcatctgttcctgtacctctctggtgtggtaccaacaattcagtcattaaccaccatatgtgtcataacacttgacatcccggacccagaaaggggaaggtacctgtccaaaggcacccagctggatcaagaccttcagtagtcatgagtgctgaaaagattttagtgcctccccatatgtaattccaagtgaaagcaatactaaacctttaaacaaaaatgttactctttttaaatggctcaaagctcacatggatgttgaaattaaaatatcttactagattctttctcccttcctctctgtcttttgtacccctgctgttggtggcctaatcatgtatttaatctgctgatttgggaatgtggtaccggctgggtcacacagcaggtcagtgacaggaggcctccacctagaagccatgccttctgacaaccagactagtgctctgccctctgcagtgatgctaagttcaaagtcagttgttcttcgagagtcattttcttggcattttctctagttggaacttgtccaggatgagaaataactcctgttacctttagtaactgagggcaccctgtggttctgtagttgtggccgggggtgagctgaagctggagaggagaaaggaaggtcaaactttctcatatagagaatatagagaataggtgtgaggcaacaggctctcttgttaaagcaaaacatagtcttctttgaatggaaaattgctccagaaaaaggatcttcaggtgggaaggggtggctggccagtgaccctgacactgttgcaatccctcctgatccctctgccatctttatacctgttcttctcccttgtagctttcaatccagttgtagacactacttgccacacacctgcatcctgactattttctgttattctagtagaggctggttggcatttcagaaggcaccttttattaaaaaccaatgggaacaagaaagtaacattattaccaaaagtgcatttagcatacacatttacagggtatggatttcttatccttcagtgctcaagtagcttaacaggctcactggctttgctgctgtattccctttctgaaggcctcaaatcgtcttttccttagatcattattttctagcctcgaaaagtgggcacaactgcgtctggaccctgtctgacctttgtgctgggtgctaaagacccagaggtgaataagacccaatgtctccattcgaggagctgccaagctgcagaggtaggtgccatctcattcctgaccacatcagcatgtggtgcctgggaatcaggtcttatttaggtggaggagagctgataaccagaaccaggaccctagttcacataccagaagattcttctgctcagtccggtttggcgtccaaagatggaatttggacttttagaattccctatggtaaaaacaaaaataaaaaccaatctgtcattctgttagtgttattgtgaatttagcaatgcttttaaatgaatttgcagttttaaacactataatgttatcttcatgcatatgaagagtagtgcttattcagtccatagacaatgcttggtggatctgcaaactaacagacttcttgtgataactctatggtcctctagagtcctctactgtcagttgggaatcgctggccttcctggttcaagctatcagctctcccctgctctgtggaactccacaatttcactcaaataagccctcattgaagttttcaagttagagggcacaggatggcaatcttaacagtcaagactactttaataatgccacaaacaggaggtatgtttattaagtgtacaggtagtttgcagtaaagtgctttgtatgaggtcatgcacaagaccactaggtatcagccagttaacttgggaggtttgagcaattaggcagctcttcctccctcccttcctctctccctcccccctccctccctccctccctccctcctttcctcccttccattcccttcctccctccctctctttctaaaatgtaagctcctcaataagatataagctccttgagggtagtagtctttatctgttttcactgttgtgtctccagctcccaaaacaatgcttggcacctaataggcacttaataaatacctgttagattgaataccttctttctttctttctagctatcgcacactctttgagtacttgactctgggccctgccctgtgctgatttctgggggtacagagtagaactaggatgcaggcccacagtccagtggggagaacagtgagccatagtgctgtggagataaggtctaggctaccggggcaaggcagaggaggcacacctgactcaggacagaggctgagcgaagcttccaggaagatgtgatgtctgagttctgaaggatgatctggagctggccgttgaaggttgaagaaggtgggggaaggaattcctggctcaggaagtagcctgtgcaaagccctggatatgtgagagagctggtgtgggggaggaattcactgccagtgattcaggaggagagggagcaaggcacctcctgactcagaataagcccccagggtggaggtggggtgggaagttcctcacatcctgtttgttcgtcagggagttggatatgagggtcttgagaaggttaaactgcatggttcaaatgaagttgtaatattaactaactgtggattttctttatctacactcaagttttcattatccttgggcagatgagacccaggcaacctcggctccttcatgctttgcagggccaggccctgggcccctctaaaaaggctagacagagcaggaggggctccgagccacagtgagaaagagagagaaagcaagagtctacctgcctgtgtgtccccggctgtgtgtatccagttgcactccaaagctaaatgtattatttatgcccctgcttttctgtgagtggggaaatttgaggcttgacgatatcttttattattatttttctttctgaatagcatagattcttcagaatcgtctgtaattcatcaaggggaaaatcagaattttttttttttttttaaaatggactcaaagaggagatgagtttttaaaaaatatctatcatctgtttttattttgactggaatcatttgcttccgagcacagtgtaattagctgcctgacaatttatagcctgatccccagtaactgaaaaataccaaactcaaattattcccccagactaggaggcccggaggtgattgaggtctccttacgttaacatcctctgtccttgggggctgagggggagggcagttctctgcccttgcaggaggtggtatctccgagttgtcagcaagacaggccttgttgttatacactgagtgtctcctttgactcagtaattccatttccaggattttatgctaaagaaataatcagatattgtggggggaaaaatgtgcagggaacccccactgcattttttggttatttgcattagccagaaaaaggaaaataacttacacattcaataataggggagtggttatataaattttcctaggtctatgtgatagactaatatacagccatgaaaagctatgctctaaatgaattataaggctacatggaaatgcacaaaataatgctgagtaaaaaccaaagataaaatttactactatatacaatatcgtctaaaacagagcacccacacagacacatacacataagaagaaactggagaagcctatgccaaaatgctgacaatgattatctcagggtgatgggattatggggatgagtggtagtattttccttctaccattctgtatttgtcaaaatttccccaatcaacatctattacttttagtaaatagaaaagacaatggatgacatgttaaggaaaaggatctttggatttggaatcgtcagcttccaggtgaagtcccacttgcccagcacctactatctgactctagtgtctctgagccacagttcctcatctgtaaaatggggttaaatactacccagttcacagggttgttgtgaggatccaaaataatgtatgtattaatgaaatgcctggtgcctatgctgcaaccatggacaccatcactaaatactaagaaggtgaaattccacgaagcttgctgaaatccctggatgggggtactgtcaagatgaagttataataagaatgttcctagacagctatgaattgcagccattcttcccttttccagaatatgtaaagaatgtttgtgtgcccacggaggagccgcatctagcctttgaggctgtcagctcatctttcccaacccgaggattttcctttcctctgactcctcccttcattctcccccactgacatctgttcactgcctcgccaaccaagggggaaaacattctttggaactgaagctgaggcaccaccaagagtcaaggcagctatgagatgtttattgtcacagagaatatgtggtgctggctgaccacagaacctgccaggctgggatgccaaggagggactttaatgaagcagcagaggatggatgcaagccgcatagccaggcagtgtcccctgcctttgggcagagctcttgtccaagtgtctcactggctctctgttttcttccccttgggatgtctgcatggctcctggttgagctcaccagttttacagaaccagcctggtttatgggtgaagaaacaccttctcacagaacttatggggcctaagcgtgtttcagtaaagtactgggcagtttgcctgagggcccagcatgcctaactctcaccagcgtggatatgaagcgaggaaaacctgagctcacagccaggcagcctcaaggacataggcacacctcagcagtgtctacaagatgccctggccaccaggcaatccagccatctccctgggtagaatccttcacactgcatgtctgattgcatttttcattttttaattacagccgtagactcatatagactctgactgccaatctaaagcacctagagagtttttttaaattgttaatgttttgctaaattcttagtaattatacaaaatcattatgtagaccaatagatattattgaccaagatatagtgatgcttaaaacaaagtcctctgtaatcagtacaacatgttggtagaatttaccctaaatgttaaaaaaaaaaaaagtactaatgctgtggctccaccccataccaataaatccagaatttctgggggatgaggcccaagaaacagtactatttaaaagttcccatgtgattctaccgtgcagcttaggtgaagaactcctgttatagatgttaaagctgggagagacccagtttcctgacttatttgaacacgcaatcctttacaaattatacttgtggataatgagcatgaactatgatgcagacttagattaaagtaagtgacaaaaaaaaatgatctcgcagatgaattaattgtaagcagtaataatgcgaggttaggttacatatatattttgtttttgttttttttgagactgagtcttgctctgtcgcccagctggagggcagtggtgcgatctcggcccactgcaacctctgcctcccaggttcaagtgattctcctgcctcagccttcctaagtagctgggattacaggtacccgccaccatgcccggctaatttttgtatttttagtagagacggggtttcgccatgttggtcaggctggtcttgaactcctgacctcgtgatccgcccaccttggcctcccaaagtgctgggattgcaggcgtgagccaccgttcccggccaatatattttttaacattataagagaacataggggttgggcacagtggctcatgcctgtaatcccagcactttgggaggccgaggctggtggatcatctgaagtcaggagtttgagaccagcctggccaaacatggtgaaactccgtctctactaataatacaaaaaattagccgggtgtggttgcgcatgcctgtaatcccagctactcaggaggctgaggcaggagaatcacttgaacccgggaggtggaggttgcagcgagccgagattgtgccattgcactccagcctgggtgacaagagcaaaactccgtctctgaaaaaaaaaaaaagagagagagagaacataggaaattagaaacatgaaaccattttattttattaataaaaaggataaatatatgatgaagtagagtaaaacatcttttattttacatattttggttataacacgtcatcaaaacccactaacattttaaacaagaatagcatttttgttttcttacgtcaccgccacttaatatcacccatgatgttactgggttggatccctacaccaggtcaatctcaacttatttttctttgcaacagaatataacgactccactatgcacgagttcatcggagtataggcaagaggaaagaaacttccagtcgtaatatttagtgttctgaaataggctgtgccagaaattccaaatagaagttggaatggttgcctccaaatcaacgtctagatcagactctgtgctttcccgtgttctctgatgtggcacactctttcatgcaggtagattattgtgttaataatacggcataagagtgaaatgtattatccacatttgtattttgtatttgtatccacaaatataatttgtaaaggattgtgtgttcaaataagttgggaaactttggagtggtctctcccagctttaaccatctataacaggggttcttcatcccagttgcacagtagaatgtataaatgtattgagtatttttaatcccatttatacttcaacaaatgcaatgcagaagaaagagtatttatcttttttcccttcatgatcgcaacagaaatagttttagaatgtggatctaggccaacactcacccagagaaaggaagaggactggggcaaagggatctctgggtaggtggctgtgtgtttggatttccagtgcagaacctctcttgtggctattttggggtcctgagacatccacttatgtgaccctgtcagcagcccccctgggaaatacgaaggcaagggggacaaagggaaagggagaactatggggggcacttttggcatccctccatagtgtgatcagagaggggagatgctaaaggtaacccctatagtttgcctcccaagcaatactgtacatcgaggatgataaataaggcatcaagaataggctgtaggtgggagaggtggcacgggcctgtagtcccagctacttgggagcctgaggcgggaggatcccttgagcccaagagttcaaggccagctggggcaacatagcgagaacttgactgtatttaaaaaaagaaaaagaggcttcagcatcttcagaggaatctgtttaagaaggctgagaagggtgtgttcaggaagagttccacttgaaatgctgaaaattgaagaaaagattaaatactgaaaagtgggaaacattccagctcccaggaaacttacccattaagagaactcatttcttgaggattttggatagcaaagtctccctgtattccaatttccagcctgtattacctcttggaataaagagttacataagtttactgcctgttgcgaaatagcccaatgaaatcttttttcccataattctgagttaatgaaaatggtagatttaggaaacaaatgttattggcttgcacagaagttttatattttgtgtctgtagcttccagactacctaatgcacatggggtgtggggtcatgagggaaggggaagagctagtgaaggagaaggttctctttgtcctattaaatatttatttcactctcgtaagatgccagagggagctggtagaaatttggcaagcaggtgtcccctccaggtagagggatggcaaagggtgctttccctgggtggattaattaggagaagccactctttttggtggaatctttagacaggcacatcctctgggaacagcaattagaaaaagtccccttttctggtaataagtattaaaatatggagtatcctctgggtggaccaattttaaaaagtcaccctttctgggcatagtaactagataaaggtacttcttcctccatgtgcagtcagacaaggcattgggcttggctgaattgtgtctccaacttgagacccctttgcagggtacccttgtaggaatacaacttgcccaacagtataagtggtcctgtagtgccaggtgccaccaggcaccaggtatacagaaatatgtcagtgatataccctgttcttggataatttataggacagcccctctaaatccccactggctttaactcgccccatctgctgccagctccacccctcctgcgtccctgctggcagagctactctctatggtgatgaaacatccaccctccagatgcccaggctgcaggctgttgtttgacgtggctgtgctgctcctgtctggggatccaggctaaatgtctgctttccacaatgaacagccagagttactggttaattgtggtggctcattgcttctgggttctagatgggaaaacatggaaatcatttaacacttcactatggctttaaaacttttctgtgttctgtttaaatgggctttgaaatggtgagttttggtgtagctgagatatttctgccctttaattttcctgttctttaataaaggaaagcagtttatctttaatctggtgatttagagctgactctgaggggtaattcctaccccactcattgtactataactttgccaggctttttgccaggtattggtgataccaaagtgaaaagacttaccttttgctcttcagtcttagcatttagttggggagacagtatggaagaagacaactttgctgcagacctcgctacagaccctttcacatagggtccaatgtgaaaagcacagagtactgaggcagggaaggttttcatagcattttcctctcgtgtcttccggaaaactcttattcattcctccagatttctattcaggcattccttcctgtttacggccctctctgactcccttcactatgttcctgctatacttttttcactatgttcctccaggtagcctaccctatgggtaggaggcagagactgccagtatgtattgaccatttttgaattcatgtttatttccttcttttaccacctcttgaaaagtaatatgaccctcttctttagaacttgaaagaacaccctggccatcccttggcctaagataaactggaagctagaagttagaggtctcttcctaggagaattaaagcccatcttaaaggttgtgaggatttggaaacagagtagaactattgaggccttctgatcccaatacatttagatgaatataaagagttccttctagctcaagggaaatcagagttacattaggtggttgtaggctagtgacgggcctttgagagtagaaagagccctgattatgaacttggcttactttgctaattttgcccaatgtaagcccaattccagtatttgctaatggaggtaatttttggtgttgagcctctgttttctgtttgtcaggaggatcaaatgaaagcctgtatgggaaaaggctttgtaaacaaaaaatcaccccccctccccaaatgttatgtattatcatcttttagggcaaggatagtggctgactcattcctttttcttcaaaatctagtttggaagtaggcacactgtgaatgtttgttgaatgattaactggcctagtaagagatgagtttttgtgtttctttaaagctctgcatgttatctaataaatccgctatattagttaatgcctacccttagcttttttggtaatttttgccattaccaatactgtgaacctcgtaacacccaagaggtggttattgactcctagatattttgcctgcaataggatataccagtgccaaattgacagtggtgtctgggctgatgcctcttgtcttaagagcttaggtttcccaccagactcctcaagggttgtattttattcctgtctgttttcccccactgccctggtatgcagtaagtgctcaatacatattttctgagtgactaacagagagagggagtggcatgtttttgcacttttttttttttttttaagacggagtctcgctctgtgacccaggctggagtgctggagtgcagtggcgcgatctcagctcactgcaagctccgcctcctgggttatgtttttgcacttctatttggccagccaaataaactccagatagcagaaagtgacagatgtcacagctagatcaccctcatcttacttttatacttgagatgacactccttttctaatttaaaaaacctttggacaaaaacccatgtttttattgttatctttaagagctttctgtgtgcctgacaatatatacatcattaactcattttatcctcacaatgattgcatgaaatagttaccattattatctcaattttcttgataaggaaacaggctcagagaagagtaaacaatttagagttatggagtaagttgagcatccacaatttgaatgcccatccatgttctccatcacaatcaatggggaatagattttactgaaagcaaggatcagaaaagaaatgtgtttttaccactatcagggaggagattttgttcaatgcactgagttgggataggatctgatggagggctttctagtggattgcaagagattcagcaggaacatatccaatgagattaaaaaaagagttaaaatgtctgggggggcacagggagaaaaaacaggaaattgagttttctctgtgaaattaactagcatttttgcctttctttctaatttatgaagctcttttacatttgttatctcatgtgattcccatgacaaccctgtgagttattacttctatttgagaaatgaaaaaaatagactcagagatattaaaactgacctgcccacagtggcaagtgggaagtgaaaaccaagaaaccatttgcactgttttaggtggtggagatacaggagtgaacaagagaggccaaaatatttgtcctcgtggaacttactaggtagataaactatgacttatttcttttcaattaccctctgtcaagtaatagatactggttttggttttcaaccttaactgtattttagaatcaccgggcacactttgaacaaaacattgatgtgtgtgtgtgcacacacactcaaattttaaacctgctctcgggggttttagtgtgcaatcaagctcaagaaccgttggtttagagcagtggttttcaaccttggctgttcattaaaatcaccttgagaatatacatatatatacatacaccaatgtctgggctttacctctgaggctaattaaattaaaatctctgtggttgtgtccagacatgtgtacttttaaaatgtgcctcctcaaatggtgctactaagttcagggtgtggggtttacatgaagcacttgagataaagaatagcttggtcccatttcacagactgtgcccctcacctcttgagcatatgaatcatcggtccttcattcttgcaacaaaatgtttattgagtacctgctgtatctctggtgagttccttctctttcctgggtcctgattcctccctttgtaaaatgagagactggggtgtctctgagacttattgcagctcggtctataattctataaaggagagtgggctgggaatgttaatggctcagaggacccactcttggagacccaggttaaattatttgtcctcttgacagtactgtatgcttcatttgagagacagaaattcatgaaattccaaaaatacgcgagcaagccttctctcactaagcagtttgtccacaaggagcagatggaatcttcttccttcgtctcattcaccatcttgctgaccatcgggttggcagcacaaatgtgcatatgagggccggatcagagggagggactcaatggggtcaggctgtgaaagtcagccagagggaacaagaaccaaaaatgtgccttgaagatcaaaagcacctggaagcagcagaaagcgagctagaggaaagcagcctaccacttggcctaattttcttttgcacctagagttggtttaacactgacagaagacggataataaggatagctgttgagaggtagcagagttagcatagcagtgaagtgcttgggccttggggccaccctctctgggtttgaatcctcactctattacttgttttctttcttttttttttttcttttctttttttgagacggagtcttgctctgtgacccagacaggagggcagcagcgcaatctcagctcactgcaacctccgcctgctaggttcaagcgattctcctgcctcagcctcctgagtagctagattacaggcgcctgccaccaagcctggctaatttttttactttttttagtagagacagggtttcaccatgttggccaggctggtcttgaactcctgatctcaggtgatccacccgcctctgcctcccaaactgctgggattacaggcctgagccatcgcacccggccctactacttgctttctttatgaccctggacaagtagcctgacatctctttccattagtttctctatctgtaagttagggatcattataataatagtacctactttatagacatgttatgaagattataagcctggcaggcattaaatatttgtcacacaaaatttataagtaatacttctaagtgttgagcactttacttgtatttgcttcttaatctttgctttatttgaaacaggtactattttcccaattttgtagatgaagaaatccaggcatggagatgttgtcactgtgtcattaactaagttagtagttattgcaaaaaatgagctaactagtaagccacagagccaggatttgaccctgggagaattgattctttagtgcccactcaactgcaggattgtataggactgcacacagccattatcttaggcttgatacctgaagataaaggaactgaattgggccctggaaatcctgaaaagggggaaatatgggtctcacccagaggagttgactctgtgggtagggacagcagacatatgcataagaagactgcaataaaagatgctttgtgcctaatgtcatgggagttcaaagtggccagtgacaggtttgttgtgatgcttggctttggactggatccttgatggacatacagagtgtgccctgggcaaggggagttgcatgagcaaaggcaaggaggtaaggctgtggatggcatttttggagttggggaaagcactgtttcccctctaccatatggtatagaagcctgggtggcccctcaaacttggtgccaaggtcgaggggcacctggtactactgggcctctttttgggaccccagggaagcagatggtacagaagcataaacttgggctgtcataggtggtttggacatccagtccaaacccttcatagcatagatagggaaactaaggcccggagaaatgaaagacttagccccagcaagccagcagcaaactatggaaggttttgtcaggccaatatttctgccatgcagtgatgcataagagagcctgggccatatcctggagatataattgagtagcacacaaatctactgtagtacccagaagtcttcttcggaacttgattccaagttttcttctgcttaactccccatactgtcatagatggagtcttaaacatgaggtttggcagacctaccgtggaggcagttttacagggcaagctgagaggaagacagggcagggacccaacatgatgtgaattatcccctaagactttgaagttctcaggtgttttcataattgttttttaagcatgagataaaatacctaggcttacaaaggaaaacaatggtactgaaagatagttatcaaaatactttttaaattgtgatatatagtagtatatgtgcttcttagcatatttcaaattacaagatctagcgctgggtcttataattaccaaaatattgaatgagtgaaatttcaagataccttcaacaactgtcatatgatctgtgatttctattactgacaaaggcacaggtattgctaacacttctgtggtttgttgcctacattcatcatttcaattagagtttagtgaaaataaacagttaattattttcacatacaagttcacgggcctcctgaactctcttcatgtaacacctggttaagaacttaatttaactcattaagaatccctgtcctaaggcaaagccgaagctggagaactgacccagcatgggatcttaatcctgctctaagaaattgacttgaaggaggtgcttgagtgccctgaaactctactcaagattgtagtgtgcatggatggttttcattagtgcaactcactgagtagttctggctctctttctgtttctttctcttttttttttctttttggcggtgggggacagtgtcttgctctgttgcccaggctgaagtgcggtggcatgattatggctcgctgcagcctcaacctcccaggctcaagtgatcctcacccctcagcctcccgagtagctaggactacaggtgtgtgccaccacacctgactaatttatgtattttttgtagaggcggggttttgtcatgttgcccaggctggtctcaaactcctgggctcaaacaatctgcctgcttcagcctcccaaagtgctgggattataggcatgagccaccacgcccagactctggctgtccttcttccaggaacatggcaggattgcacttcctcacccccttgcaattaggggtggccatgtggcttgaacctcatcatattcagaattgattccacattctatctgccctgcccacctctcttacctcacctcccacccgtttcaccgggtctacttcagctgtgctggcctcatttctgttcctcaccaagcttattcctgcctcaggatccttgcactagctgttctttttggctggaacactcattccccaactcttagtatgactggctcattcttagcctttagaactcactgttcaccttatttttaacagctttattgaaaataattcacataccatttaattcccccatttaaagtgtataattcagtgccttttagcatgttggtggagttgtgcaaccatcaccacaatcaattttagaacattttcattaccctaaaaggaaattccattccccttactggtccaattccccatcttcccaccagtccctggtaaccactaatttactttgtgtctctatggatttgcccattttggaaatttcgtattaatggagtcatataatatgtagtcttttgtgtctggcttctttcacttagcatgttgttttcaaggttcatccgtgctacagcatgtatcaatacttcattattttttatggctgagtaatattccattgtatggatggaccatagtttgtttatccactcacacattgaagagtatgtttctatggcttgttcctatcctttggctattatgaataatgctcctatgaacatgtgtgttcaagtttttgtgtaaacatatgctttcatttttcttgggtatgtacctaaggaatggaattgctgggtcatatagtaactctacatctaacttttgaggaactgccagactgttttctacagaggctgcaccatttgatattcccatcagcaatgtacaagggttccaatttctctgcatcctcaccaatacttgttattttctgaattttttattatagccatcctagggagtgtggagtggtatctcattgtggactaaacatcttttcatgtgcctagtggccatttgtatgtctttttagataaatgtctattcgagtcttttgcccgtttttgaattgggttgtttattattttgttgtggaattatagttctttatgtattccgtatattaatccctggtcaggtatatgacttgtaaatattttctctcattctgtgagttgccttttcactttcttaacagtgtcctttgatgcacagaagttttttaaatttgatgatgtccaagttacctattttttctttggttgcttgtccttttgccatcatacgtaagagaccattgtctaatctaagaacgtgcaaatttacatgtttacttttaggagttttatagttttagctcttatattttggtttgtgatccattttgagttaatttttgtatacggtgtgaagtagtggtccaacttcattctttgcatgttcttggatatccacttgttttagcgccttttgttaaagagactattccttcctccattgaatggcattggtatccttgtgaaaaatcaattgactgtaggtgaatgggtttatttctggactgtcaattctattactttgatctatatgtgtatccttatgccagtagcacatagttttgaaaactttgattgctttaattacttttgattactttgtagtaagttttgaaattgggacgtgttagtcctccaacttagttttttattttcaagattgttttggctattctgggacctttgaatttccacatgatttgtaggatcagtttcttcatttctgcagcactgccttatttttgcccagctgtttactgtttatcaaggatatccacattcattttttctttcgacaaatattgattgagcacctaccatgtgccagacactgtgccaggtgctgtgaacaattagccatggcccttgccttcagggagctaagcatttagtgggagaagcagacattagtcaaataatcaccaaaataaattttaaatgaatgatagaaatgattgacttagtcgtgggggaccaagaaaatccttcctggagaaatcaataattaggaaggtgcctgagttggaggagatgtatgggaagagtattccaggcagcaagaacatcgttctcaaaggcgagaaaggaggatgcttttaaggaactgcaaggagacgaatttgatgacctacaagcacaagagaaagagcagcatgagatgagggcgagctgcctgagggggaccaattctacagggtctgtgggccaccgaagcaaagaagtaacatgatctgattttgatttcaaaatgctcactctggctgctgtgctgagaatggactggagaggggtgtgcaagatcagtgccagttaagaggatattaccgtagtccgagagagagatgagggagggctagatgaaggtggcgatggcaaccctgcagaggaggtggacagattcacagatgcaagagaaatggaggaggtttcagagtcagtccttggttcttgaggcctatgtgatggtgttggcaggggtggtcttcaccaaaataaagagtacatgagtgtaggtggctttggaggaatcattgttactgagtttgagatgccttccagatattattaagttatctgatcctcactccaaatcatccctatgagaaaggtgtaagactcttctcttcattttgcagatgaggaaactgagtaccagagaggttatcatggtttgcccagtgctggcctgccaataagtggcaaagccagaccagaatcctgttattctaagaacaacccttgtgctttttcttttccatgacaccagagctgactccctagaaaggcccatcccaaatagtttccaataataagtgaagatcactactaggacttctcccacagacaccaagtgtttcccagccctccacacctatgctcccagggaagcattggcctcctttttacagaattcatctctacagcattgctaccaagcccctccaggagtgtttagatcttccaagtatctgatttgtaaacctggatttgttgtttgtgcacagagagctacactgcctcttttcccagtgagagtcgccctgtccaaaagccttcctttttctctactgttagagacaagggtcacctgtcagtagtcaatgtatggaaagctgaaatgctgagacattgagccagaagatggatgacagaaagactaataatagatgacatgtcaaggtgcacttaacttttttttttttttatgttcaagtagaggactgtgaggagaaggaattgaacaggtggcaggaaatggggtgaaatgaaaaactaggagaaagtaaaacaaatacataaattcgaggagtaggaaaaagagaaaataaagtagtgaaagacataggttggggaggagatatcctagtttcaaatcaggctctgacatttattagctgtatgatcttaggcaagttgctcagtgtctctaagtggacataaaattgcactaactttatggggtttgtgtgaggattatagggagagcatgtaatatccttgccacagtgcctggcacaagataagcactcgataactgtcagctgttactatgacgtggaagcccttcctcatttctgctgcctctgcttcccccagctatccccaggcaggttcattttggccagcttggttcaccattccagccactgagccaaaatcccaactgaggcaggaaatattgcgttggcttcagcagacccaggagctggggaacttgtgacaacagctggactctgcattggttcctggggcttcttgctgccaatttgatctgcgatcaggcacctccaagagcgacccttggagatccatgctgcctctaggttgtttcctcctcccttcctttccttcctctttccctaccacccccaccatattgacttctactaaattctgcctactcactcttctttgtattccagttctcctccaggaccaaagtcctgtcctctatcctcgttttggtacagatttcctgactgctgagcagcctacttgcttgacttctttcatcaataccatgccgcttcccagggtttacataactaggtttgttaattgcacactctgaacattgtacttcactcagccagctcccttttccttgtagagcagtggttaagataatcctttgggatctcacacttctttaggactcagttgaagccataatgcctgctcccaaaatacacgtgaattcaatgcacgtggataggctaagttatgctccagtggccaccactatcaaattctcactcgctggaactgtccgatgtggattgatgggagggatgtgttcttcttagtcactcagtaatccaggctggtggagcttccctcttgaacatgtgcttccatggcatgaaaaagaggtataggatctgacttaacgtttttaaaagatccccctgacttctgtgtagagaatggactgtgaggcagcaagggtggaagcagggaggcctggaaggaggcctggttcagaggacagctgacggtgacttgagccacacagatggcagtggagggggaagaagtagatggattaggatctgttttggagtagagcagacaagattttctgctggattggagatggggagtaaggagaataaaagagtccaggatgacctccaggtttttggcttgaacatctggttagatggcgtccattcttaactagcatcaaaaccacagaatccttgactttgtcaagacatacctgagtgataactgaaaggagcctcagcttggacttcttttagggtgcccttccagctgttttgtaacaatataactggcaggaccgtttttttgtttttcaggcaagctgttcagtaaaggacactcatgcacacccacatgttcacaaacacacactcacacacatcacatgtcacacactgctgtggcagccctttctggacctcacacagcaccattcccgggagtccttcagggtctcttacatggtcctgtcactatttttgtttcttatacaaatcttttgctaatgattctcagtttaaaaacaacaaccatggctgtaccctcaaggagcctcatcctaggaagcagccctcttctgttttgtccctgggagggggtcagcagcaatgagtgacctaggtggtctgaagggccttttatcctatcagagtggtttccagcctagggaaatgtgaaaaccatagtagtagcacacttattaaaccaaatgtgctgctgcaccatcccaagtggcaatctgtggctgttaagtgcaattgctaactaaatgtgtagcctgttgcctaggcagctcatttgaaggagagggggttgtggaaaacgaaataaaatgaaagagtcttggccactgacctggttggttccaggcggagtcggttctgaggtacactctgtagctttagtgtttctagggcctcagggtgggagttcacattagtggtgtaaacaggtactaatgggttccattcagatgctggttgccaaactttctctcagaaaaggccagctgggcagcccttcaggctgtgtgcttgagaggggaagtggaacaaaaggagggccctgaggcagggaggggtgagccttagtacagccaggactgggaagctgcctgttggctaggaaaagcctaggggatttgtgagaggccagaggcttttcataaataggaattagggttctgtggaggggagtgaatctcactcctgcctggaaaaaggaaaaatgtgtgaggtgcctatcttccttcccaccaccattatctgtgtccctcctggaaagtctgaaagccaggtgttgcctatgagtgttttgcggaggtaaaggcacacacaggtaaagttacataaagcttctgtgagataggcatcataagcctatttgacagagggaagatggagctgcagagagagggagtgatttgcccgaggccacacagctaccaagtggctgtgttaggctttgagtcaacctcttgacacttgattaggggatactgcttcctaggcatggtgagaggcaggctgtgctcccgaagcctagagatgggagcaggaggctggttcccctgctctctcctgctctggggcccaccacctgtcagtcagcctgggggcctacgtgaccttcagggttctttccagcccttggagccaaaagctctctgaatctctaggcatgtttcccatccagaaatttaggcagtgggtcagtggatggcctctgaggggcctgccagctctgatgttctgaagacctggaaagagcaaagagcccaatagtttttaatgtgtgatccattgagccctagggaatcccacagaggtgtttcaggggctgccatgagcagttctgattctgtcttttatatattagagatctacagatgatttttgtttgcaagggagtgccacttctaaatacaaacaaagagaaacaaaacagaaactttaaagcccctgaactagatagtgaatgagagacaagtttgaacgaaggtgtctgctgtggtgagagtgatgatggtggtgtgtgtgtgtagtggggggagtttgaactggaaggaaaaagaggaaaatgaaaacaagaggaaagaatgaggttacagtttgggtcagtggtatgggtcagttgccattttgaaaagaggagaaagtagaaaagggaaagggaagcaacagctactgagtgcctacttgtgtgccagtttctctgcttgcatcctcactcataggatgcagacagcaaccccttgagttctaagtattattgttcctattttaaagatgaagaaattcagacccagagagtgaaaataacttttataagatcacatagcaagtaaattgtgttgctaggattcaaaccgagctctttttgacctcaaactctacaccctgtcctgttaggagctctctcctagaagacagttgaggagttacaggtggatgggcatcaagaacacatagtacctttcttcggcagcagcagaggtctgggagtgcttgtggagaacaaaaaggtggagctcatgttctcagtaatttgggaatttgagagagggggctgtagccagggtggagggagaaccaggggagacttaggaagagaaatcagtagttccacaaggctggagagtcaaagcgtcaccaggaagggcctaggtttggacctggaccaaaggacctagaacctcttaggacttgtgtccttgaatggacaggtttggactcttggactatactgtgcatttcagaattgctgtttgcatccagataatcatcacgtttgtagccaagtgttttttgcctcatttgttaatgtaataatattaatataacaaacattcatgaacccaccacccaaatcatgatctagaacattgctaaaaacttacccttactaatatgcttaatattttttggtagtcattttgataaatgattgtctgtcttctcagtatggtggttgtggtttcctatctctaataatgccaaactccaaaggaaagatgtagcttgtgttattggtcaggatgaacaactttgtgccgtgctaaaagacatccccagaatcctagtgggtcatgacaacaaaggtttattctttgcctttgctttatgtctatgatgagttagctgagggctgtgctccttgtctctttaccttacagctccggtgatcagagaacctaccgttgtgaacattgctagtcattatgggaaagggaaagagagccctgtcaggcagcataatggcatagaaatattccagcttggaagtcacatatatttacttctgtgccgttggccagaactcatcatatggttccacccaactgtaatgggccaagaagtgaaatctcaccacgtccctacaaggcacagtgctgggaatatttgggaaacagtgctaatgactatcatagcccacttgcccactgtggtacaacatatgaacatgacttgctcctagctgatgaagttgtggagaaggaagggattgcatgagcagggttgaggaagcccacctgagttttgtccatccctgtgtccctttaggtgataccgttaaggcagcctgccccattatgcaccgattttccagccagagcccccttccccttggaagttcgccattctgctctacctgtttctgtctgtctgtatttcacaggcttcaaggacacagggcatttgaccatagagtctgactagcagctcacttgagatctccttggcgtcttcttctcccatgcatgattgctcagatatccaaggagctgctgctacctcatccagaatggcacttgacttgacagtggtgggattggattttgtgcagagtggtgaagggaggcgagtagggttgggtgagtcatcattgttatttccgttgcattcccatcgatctcacaaagctattaaaagagtcagtaactaagacatagctcgactctggttctaaaagtcaagtgataattgaaattcacattgcaaatcctgcccaggaaatggagtgaagagaatgcactggctcttggccccactgctgggaaggaaggtatgagctgatagctcaggaaacatatccttagcttgagagcacaggacctgttccaggcagctggccccaggatgattcctctgaccactgagtgtatggcttggagaaggcaagtgaacagagagggctttgatatggtttataccgtaaggtgcggagatgagcaaaacagacaatgtccctggtctcacagaaattagagtctagtgggggaagaaaatgattaaacaaatattatagggcatggcaagtgctctgacaaggctgagtacagggtaataaggcaatggcagctaagctggacttggggagccaaggccagcctcctagaggaatagtccttcatctaaacagaggactgaaggataattaggtggtagccaggtgaaggcaggtgggaaggaaggaagttgcagaaagttaggaggtagaggggagtgggagaatcggagcctagagaggcaggcagggactagatcatgaaggaccatgtaagccatgttaaggggcttggacattatcctgaggggagcaggggaccatggaatagttggccattcagatcacacttgcttttcagaaacatcactgtggaagcagtatagaaggtgggttaggaagttgtgacattggaggctgggagtgcaggtgacctgcttaagatatttgtgatggagatgggaaggaatggatgaatctcaggcacatttagaagaaagaatagacagatgtggacagtgaaggaaagtcaggcatcagggatgatgcctaggtttctggcctagacaactggagagcagtgatgggagaataggttggtggttaagcgtagtggctctgaagccaacctgtctggattttgaattccagatctgccactgattggctgtgtgaccttggacaagttccttaacctctctgtgtctcagtttccttacctaaaacgagaatattaacactaccttccttttaatgattaagtgaaataatatatataaaatgctttgaactgtatctggagcatagaaaatgttcgataaatgttagctattataggcaacaaggaagaggaacaggcttcataggaatgatgatgagttcagttctgagcatgtcaaatttaggttgtctgtgggacactcaagtgcaaattggttatatggatctgaggctcaggagatatttggctagaaatataaatttgagagttatcagtttatagatggtaattgagaccttggaagactgtgcagggagaatttgtagagtgggaagaaaagaaggcctaggagcaagacctgagaaccctcaacatttgtggacagaggtaaaagagcctaacgaggaagctgagcagcaaccagagaggagggagaaaaatcaggagagaacacagcatcatagaagccaagctacaagaaagtttcaagatagaggcagtggccaatggttgcagtgctttggagaggtcagtataaaagaagatctgataaacaacaatgggagttagctacgagaaattgttggtgagactagtttcgtggagtggtagaactgtatgtcagactacattgggttgaagagtgggagtgaggaaatggagacagcaagtgtaaacaactctttccagaagtttgtctgtgaaaaggaagggtgagcagatgattgcaggttatgggagaagagagggcatgcttcagtgctgatggagaagaggctgacagtagagagggaaagatgggagacacaggtgagggaggggacaattgaggcttgaagtccctgagatggtgggaggagatggaactcgcagagtgcaggccaggttggaagtgttaatcttggttgggaggagtcataagagggaaggcagaaagtatggatgtggtgagtgaatgtgcagatttggttgtgggaagttgctgcctggtggctttctctctgtgaaattgggtgagggggatgtggcaaggctgggggtttgtagatgatagaagtgctcagagagccactggataaaatggaagagagagcccaatggagacggaaaataaaaagggttgcctagttgtaccagaggcccagtaggttcatagcggttcccagctgcatggttggagtattttcaccaaggagtgcttagcaatcctggagtaggagcagaaagggtagacatttggattgatttaaacatcacttgtggatttgcaagatggatgaaggatgggcaatggagtaagaaaggtgcggatgtcggtaagggagtagttaaaatgattgactcataattctcctactctctgattcagaagcttctgtttctgctgctgcttacaacttctctctattccccactccatagcttctgctcattcaaggctcttatgctcatggcttctgcctcttgtgtatgtgtgtgtgtctgtgtgtctgcttttgccttcattactgactgaagaccctctccctgtctcacattcagaatccacaggaaagactatctgagtgattctatgggtcattgtattcatgtttgactgataggtcaggtcaccccttaggctgctggccaacctatgggttttctgccctgagtcagggatctatgtctggtccagtcagcgtcaacatctttcagaaggttttgtgagtaaaacaagcagaatggttaaggggctctggaacctgatgcctaggcttgaatccaggctgtcccacttattgtgtaaccttgggagatttacttcacctctctgatccccagtttcctcatttctaaaatgggttcagtaagtgtacctgcctcattaaggtatttgtgaaaatgaaataagacagtactaaaaagcacttagcacagtacctggcacatatttatttccctgtaaacattacttattattacaatcattgctattatgattattttactatgaaagcaggcactgggggcctaatagaatttagaaaagacattaggggagatgggatctgaactccatcaccattgaataaacacagtcttctttccttcacaccagctctttaccattttctggtcttctgacctttcctcagggaatgtttgtcaccttgtgggctctaaaggcccaaagcctttggagtactgagtctgccatgagctggggatcgagctgctgggtctgctcattgtcagcttgggaggaatcctggcagcgaggcctctgttgctcagtcctcggtttctatgagtcatgctcctcttatgctaagtccagctcagatttggaagggggctagaggagtgggggtggatgagggaaggaaagggaagaggaaggcagcagtttagcctctttctgagtttcttggttagctccagttatgggaatctttccttagagctctagtgagaggatttgaggccccactgtgaccagactgcaatgtgaggggatccttcacctgcatggtgcagcctaagatgcctgatgtgtgaccaacccctccccaggcaccctgatagtcagggcatcttctctccatctctcttttccttacagcttgatacagatgggtaaagattctttttcccctgaagataatgtaacttgctgatgtaggggaagggaatgtattaagaggcccattgctcagatatcaggctccttgaaatgacctggtccctgatgacttgtgtctgagctgatgttttcctaagggtggtgtttaggtcactagtgaaacatgaaataatttcaggtagtacctggctgaacattttttaactttgatagttatgcatttattttcatgtattttagaagaaaatataactaacatacaaaactggtggtttcaagggtattattgtttaaagccatgtaaagttttagaaaaggaagtttatttaaagaaaaatactaagtgaatagtagtgtaggtgttagacatgtagcaaaagtcatgaaggtagtacacagatgactgaggtttgggaaagagtggtcttaaccaaatgacgttcccttttctgctgcctcttttgccccccacccccagactcaggatgtctgcgttgggaattgtctaatagacatagtaatctgtgtggtcaactgtcatctgaacaggtcaaagtcaaaagccccatctccctttcttgacttcctagtctttgtcgagggctctaatgctctctctctctctctctctctctctgtgtgtgtgtgtgtgtgtgtgtgtgtgtgtgtgtctttcccagcctggtgattggtaatatccctgggatccctccctcttccattttcacactgaatcttgaacaagtcctgttaattcttccttcagagtctctctctccctctccctctcttttttttagagagaggatctcactatgttgcccaggctggattcaaacttctggcctcaagtgatcctcttgcctcaacctctcgagtagctgggactacaggcgcacgccaccatgcccatctcagaatatctcttgcactgtgctccttccaactgtcatcacccgtttgaataccacagcctcagtctatacttcaccatccaattcatcttccttaagcacaactttcaccatgaatttctcctggattggttttccactgagtatcagatcatggccagactcctgaatgagcaattttcagtccttggactatggcttcagcctaacagtatctgcacatatcgcctgtttcccttctaggacccatctaggtctttactattccacagatgtactctgcttacctctagctctagctctgttctatataccttgactaaaatagtttcttcagtcctttccatttggttacttacttattttccgtatattgctttttgtgtttcatttgtgtctctttaagtagactcagcttgctgaggtataggagtgtacttttcatttcttttgtaacctctttggcatttagcaacatgcaaggcatatgggaggtataactgggtatactttggcctgaaagtaacagaaaacccaacttagagtggcttaaacaaatagaggtttattttttgcataacaaaaagtttagagttaggtggttgcctgctctgccatccgtagtgaattggctttcatcctacgcttgttgcctcatggtcacaggtggctgttgcatcttaaggtatcacaactgcattcaagcaggaagaaggagcaaaggttttctgctcagggggctttgtcctgttatttgggaagggagacttccccaggagactgccccttacatttcattatccagaaccctctctccacactcttgagtatagcctgctagagaaaagacccaagttcaagttacaagagtgtggactgagagacttggccaatgcctgcccacctcactctgcttctgtcacatgctccctcttagaccagtgactgatttagaccaatcataattcaagcctgggactgcagttgagttttccctctctgatatgaaagaatctttgccagctacaaattggagttctgttagcaaggaagaaggtgcagaggatggctgtgaggtaggcaaccagcaatgtctaccaaagagctcaataaagaccagtttagagagtaagtggcctgctccggtcctgagtcaggttctaagatttggtaggtctaaggccaggaggtttccagaaagagccatcttctctgtgcccaaacaactgcacctgaatttccctgactgtccattggaaggtcaagctggtcatatgggctttctcggctgtttccctcagccaaaaggaagagcctgtgtagagcatggtgctgtcccatttagttactgctaggtgagtagcttctgcctgtggctctacttcaaggactgaggggagaatgaatggataggcttgcttcttcatggaaaaatcatccctgcccttggagctttggttttcatatgttttctggagtagttctggaattgaatttgcacccaaagaaaaaaatctagaagaggaaatttccaaaatcacattgtgcaaagtgttatttattatagcaagaaatagaaacaacccaaacagccaataatagggatttggctaagcagactgtgagttttagtatattaggctacaatacagccaccaaatgtgactacttcaggaactctgatggtacaaaaatatatatggaataatgttaagtggaaaaggcagaaaaaaatagtaggtacatactggctgtgtaaaatgtacatgtgtgctttgaaaaagatcagaagacagttgtccagtttgaaatcaaagaggaattaggcaaccaagatgtattttttgaaattgaatgccaactctgaggcagttgggggggtcatccgttggggagtccagttcagctgaagtttaaaaagtgggagttagggcatccaatactattccttctttcaccatgaagacggaaaggttaagatagagcttgaacttgaacttgggtcttttctctagcaggctacgttccaaatgtggaaagagagacttggcctctgtgggcccacctcactctgcctcactgctgagaagtcccctttcttctgtctcgcagctgacgaagcattctgttggaagactacacttccattccagaacagtgtgcgttactgtgtggagacccagtgtgagttccttcctgaggtttcttggcactggctgtgctcctgcgtccccccaccccgcaacccctgccgttcatcatccaaggtttacactgtaaatatctgaatggggtgaaaagaaaaaccagacctccgacttggggctggtctgctggaggctgagccaagggtgtgttgttgatatagaagatagttctctcctaagagtttactgaaggagattatttttgctggttcaggttttccaactttattcaagagcctgaagacaggagggaagcaggatgggtgtgtatatgggctagcagggaagagagacttgtttttctcttttttcctgaccagttgctgcccagcaatagctgccatttattgagcgcttactgtgtgctgtgtgctttacacatgccatcttgtttaaccctcacaagagctttgccaagtattacccccacacacactttacctttggggaaacaggctcagaggggacttagccagagtaacttacccagggaataatgaaatcaggatttgctcaacaaaaatgtattgagccacctactccaagacaagcctcaggctgacataccggctgtgcggctgtgaataagatcggctcattgtcttcagcaacttgtacccataagggtgggtgtgacagataagcaggcagtgataggacagggtagtgcctgttctgatggggaagagcctagtgccatgggaggacagagaagggggaacccatcacagacaggagcaggaggcagggagtcagcaaaggctttccagagaaagtgatgagctgtatggatctggagaaagagtacaagtcagcccagtgaaggagatggccaataagcaattcaggcagagggcatagcctgcctgttgattaagtattcaagaattttgcaagctggttatcagaccattggtcacttcaaattgggtcatgatggaagtgtttatagcaaggaagggagttgggagttctcagctatagatgtgaatgggattaccgtggcaggctatacagagtgccaggccgaggaccaagccttggtaaatgctaagaggcaggcagagaaagatgagctcacacaggagactgacagggagcggtcgtctggctccactttcacaaccatctcatcatttccaactctgttaccactgcctttcttgaagcccatatcatcttatatctggactatctagtcagatagtctttacaacttatctcctggtttctcaagtctttttaaaagttccttatagcttttctgctaactgggtaactgggtaagtaaaataatctggttggagcagacagcttatatagaagagtatggattttagcatgttcactcctaccacttgctggctatgtgaacttgggcaagtttcctggtttttctgaacctcaatttcttcatctgtaaaatgggactagtacttccttctgctgccagggctctgagaatccatggagactacacatgtgataaagggcccagcacagggcctggttcaccattggccagtggagaggtcgccaaagattttcccatatggtagctggtatccacaggaaggctcattgaggactctgcaaacctccatcctcagctgcgcaccctctacctgggcactccagcttctctcacttcccttgtctgctgctcctgcccctctcctcccttccattctggcaaaattgaacaatggccccttcctctaccctccctgcctcatgctcaacctgttcacactccaggagcctgaagaattcctgttcctcaccagcccatcagggcttccctctcctcactccagctgatccttgactcttggctcctcctagaaacgtccttgggccatgggcctccgttcctaacctcgtcctgcagatgtactaactttagttcccggaaccggattgaaaggactagaatgaaccgcatcaaatgttaaggaacacaattcaagaacgctgcagcacttttcatgtgctatacaacagattgtgctgaggctggggggcatagatgcttgttggcagcagggttgttttccaaatcactccctgatgctttgaagaggaaaaggaagtaagttaggagactagtattcattgaatgcctcctgggtgtctggccttatgctagggtgcttcataaattgtgtcattcattgtcacaacaaccttgtgagatgatgatgttattcaagttgtctgtagtgtccctgcttccctgtgagctctgtgaggatatggaacacactgtcttcgacactgcatctggcaacctggatggagttggagaccattattctaagtgaagtaactcaggaatggaaagccaaacgtcgtatattctcactcataagtggaagctaagctatgaggatgcaaaggcatagaatgacacaatggactttggggattcggaggaaagggtgggaggtgggtgagggataaaagactacatactggatgcagtgtacactgctctggtgatgggtgcaccaaaatctcagaaatcaccacaaaagaacttattcatataaccaaacaccacctgttccccaaaaacctatggaaataaaaaaagaaagaaaatggccattaaataaaataaaaagcaaaagagatccaagagagaaaaataaaaataaaataaaataaaataacaggtgtcaacacacctaaaaagaagaagaacatggagtctgtgctcaataaataccggttgaattgaattgctgacactgttgtgttgaggcagtttggcccaggcaggcaaataagcccaggatttgcagtcttggcctgtgtggctttgggcaagctatttcatttttctgagcctcagtttcttcatgtgtaaaatgggaataatgacacctatatcccaggggttgtgagcatgtgcaagtggtttggtaaactccaagtgctgcccaaattagtgtgtggggtgcatcacatgcgctctaagctaggcttttagttatccaattatcatctaggtctgcagttcccaaatgcaaatcagcactcatccttcgtaaagtttttactcttctgaattaaaaaatgatgatgtaggccaggcacggtggctcacgcctgtaatcccagcactttgggaggccgaggtgggtggatcacgaggtcagaagttcgagaccagcctgaccaatatggtgaaaccccgtctgtactaaaactacaaaaattagtcgggcatggaggcacgcacctgtagtcccagctactcgggaggctgaggcagaagaatcgcttgaacctgggaggtggaggttgcagtgagccgagatcatgccactgcactccagcctgggcgacacagcaagactctgtcaaaaaaaaaaaaaatgtagttttgtttttttttttttgagacaagttctctgtcacacaggctgaagtgcagtggcatgatcatggccactaatttttgtactttttttttgtagagatggggtttcgccatgttgcccaggctggtctcaaattcctgagctcaagtagtcctcccacctcggcctctcaaagtgctgggattacaagcatgagccaccgtgcccggccgatgtagtttttatgaagccaaatttgttcagttttttaaattctaaaattgtcattccaattgtttgatgttaaaacatcattttgttgtttatgacatcttggttttagtatatggcagtttttaaaattaaaaaatgctcttacttgatcaaataaaatgttggcacagctatgccagatcccccaacaagaaaagtagcatagaggggctgatagagaggaacctgggctgggcgtgggtgagaaggcatttgaggtgggcttcctgaaggcaagggggcctgaggagagttaagaagggtgaataggagaacattcagcaacaaagggtgggaaagacacaagctggagagctgggccaggatgagtccagacaacctctagaaatctgtgaagtctgggccgccacccagcaggtgagcacctctgagcttccctgtggagtgttagggtcggggagtgagccgatttgtcccagacccgcctggctcacacacggggatgaaaaagtccaggtcactgcattggacagccactgagctcccccaccacagcccaaaggggtgccttgcggtccgtccaggcaattgctgccacactctgcatcaaacccccaactccccgtctgactttgcctatcctccacctcctctcctactctggcagcttcagtaaagcaggaatcactcagctctgtgtgtgggaaagcacagagcccacagcgcaaacatacaggctcatcggaaactcgaaatcccccctctgccttccacataccaagccacacacaaggagtggcagtggggtagaggctggttcctttctccagaatgccacagggctggcctgaggttgtggtgggggaagcacttccccctggccagctgtatgacctctggattccccagaccacacggttggcagcaggaggcccctggcggctgggagcgccagacccatccgctggggcagagagtatgaccacctgagcatgcgctttcgcattccaagtggtgggtctggattatccatttcttggttttctccagacctctgctccatccatcagagtatttttttttccacctggaatcctttggccagtgggtgcagccataagtttgtccagccaggggcatacgccaggtgcctgccgagctgtccatctggcccaggcaagaggcaaaggataacttccagaaaaagagaaagcccatgagggcagggcagaaggcaaggctaaggagtggaagtaacagtcccaatgcccagcccaaagacctaagcctggccaacaatactcggcaggcatccctcgctccctgtttagggcaggttgccatggtattttgcctgctggtgcactgggactggaaaaaaagcagagtgagcctgagggtggaggattgggaggatggttaataatgggaggagagctggactttttgccccagttctagctggagtttgcttcagcagcagagtattgtggctgtttcagggagaagcccttgtgcctttatgaccccagggattcctgctgctataagtgcccaagaatggcatatgccttacaagctgcccaagggccgggcatctatgccatggctctgctcccacttgtgacatggtgggtctttcttatggcttgtaaactctccccatccctgtggctggacttagacagctctgtttatcattctcacactgaaccaactagccatttctgtgggtgggtgtcagtcacaccctactgatttctggtatatcctgacattgagtagcagcctgtagctgtgatggggagaaaggttaatgctcattttgacagaagcattagagttaagtccaaactcccgggcttggcattcaaagacttcaacaattaatcttctataatgctcaacattccaatgccacatatttggaccccaaaatacaaaatacacacacacacacacacacacacacacacacacaaatacctggcatcatgttgaaaaaaaatagtggatagaaccttttcagttttcatttgtgtgtttgccatctcacagttacaggtatggtgtcaaattttatttgcaaattgacaatctccaactctgtgtgtctaaatatatttggattatcagtacttgatatagtgattggtgtctctgtgtttatgtgtccaagtcttacctgcactgacaggccaggcaaactaatttgttctccctaagattttagacataaagctaacataaagctttgctataagaaataggttgaggagaatcagccaagtccctgctttcaattcttctggatatatatccagaggtagaattgctggattatatggtaatcctgtgtttaattttttcaggaactgccatactgttttccctactggctgcaccattttgcattcccatcaacaatgcataagggcccaatttctctgcatcctaaccaacatttgttatttcttgtgtttctggtaatgtccagcctattgggtgcaaggtggtatcttgtggttttgctttgcatttccctaatgactagtgatgttgagcctcttttcatgtggcaggcatgtaagtttttgacctgttgatgaaactgcgcatttagtcttgttttccaaacactcttggacactggatatggccattgttttataggttagaatgacctttacttaaagaatgctttgttgtgcagttacctctggactctccacatgctttgaaggctgcaaccttacagccagtcagccctgtggcttctctatactctctgcccctcactgtagacttggctttccataagccctaagatttcttcgattctctgttttctgttgtatttaacccttatagtcccaccctgctgtgatagccagccagccatcctgaagaggaaaagattcagggaatggagaagaggggaaaaggaaggaggtgacagatttctctgaacccattatctggtcaaaagagtaagtgaatctggtcctccttctatgcaaaaacaaaaccaaaaacaccctattttgtctgtctatcaagcagttctatgccttcttagaaacttgcctattctccaatatgggttgaagtatagaaaatgtagctatgagagggcaagtgtcaaaatgcctggatttgtcactaaaaatgctatctagggatttcctttactgattgatctcttagtgagtgtaaagagccagtgaacctcatggaaaacaaaagtaagaacaaaaaggaagcccctccaagttcttagcattacagtaggagtgtttacagttggagaagggatgctgtcttagtcagcttgggcagctataacaaaatgccatagactaggtaatttataatgaatagaaacttatttttcacagatctggaggctggaaagtccaagataaggcgccagcaaatttggtgtctgatgagtacctgttcctcatagatagcaccttctacgtgtcctcatgtgggagaaggggtaaacaggctcccttccctcaagcttcttctataagggtactaatcccattcatgagagctgagccctcatgacctaatcatctcctaaaggcctcacctcttaatactatcacattgggtattgggttccaacatacgaattttggggggctaccaatgttcagagcatagcagacacgtgtcttcagtttcaccttcctgttggggtcctctccctgatccccactgtccacactataccaggtggcctgggttaacccacctggggaccagatccacattcttctcctttggactcctgagatatcttgcattctcatcaggaaatttgtcaaatactacaggacagcaaggaggaaatcattgcaaaaattacaatgaacagcatattaaataggcaggtttcctgagtgtaagttttgggtccaacagtgaatgcagtctgaaccaccaagagccagggcatcgtggctggtcccttgcctgacgtccttctggcccagctcccagcctgtctctggggagtgggtgccatctaactctccactgtctaggagaagtttccaggataagaccagaagagaccatattccaaattagctgttcatttgggccctctggctctaaacctggatccctgtttgggaagtagctgtgcctccctgtatacatcctcaaggcaaatggtcttgttttctagagctggcttcccaaggtagacctgtgtcccccagagagtgggagtccatctcgtgcttttggatgggacacgaattagtattatgtttttaatagcaatgtgtttactttcgtagtttccttctatttaagtcatgtggtagtggttttccatttacatcaatgagtcacagattttttaagtaaaagagtaagaaattgaaaaaaaattaactaaataatagttaagggggtatgtggatgtgacaaaaattgtgaaggtagcccccaagtgactgaagattgggacatacttccttagagtgacttgcctctctaaaaataaccttttaagagacagttgccaggaggactgtgtgaaagaattaccaactttgggttccagggatctttccctttctggatctctgatgctctctggtgagagcaaggaaagcctagaatataattttctctcccctttgaatagttctactaataggctcctctgtgagcacagataaaggggccattgaccatattttatttcttcattagcttcctgtaatgctttccttgctgaaattcaaggcagaaatggtgtgcctaaacctcagattactcttcttcagaagaatctcttcagctcaatagtttaccttctatccccagcctgcaccttcgagaaagaggatttttcaaatcttttctcgttttgctcctcactctcccagcacatattttccagaagcattacatgggaagcattcataaacattttttgcactgaagaaatctgcactaagcttgacttctgcttataaaactactccttgctccattatgttacaggcattccctggggggctgtccctggcatgctaggaagggactgaggcatctggcgtttatctagtccctgagccaggcactacatgagccaggagctacactaggccttctatttgtttgaattctggctgaattctcaaaccagcccagtaggtgtcatttgacatctgaggaaactgagctcagagaagctcagtaacttgcccaccatcacacagcaaggaaggggcagaagccaggaggacttgcccccggtttcctgactctcatgcactgtgcactgcctctgtgggggcttgctcttttctgcctggcgtgtgctgctgcgctgctgtttggacaactagcaaaaggtctcaacacaggggctttctcttttgcctgcaacaacaatgagctcaaggggaaaacagattgattaaagctgattttgccctagtgagaaactggccagagcatctctggagggcctcgggctgggcccagttggctgtcaggatgtggcctggagcctcacttcccttcctggctctccctttatcttctacactctcccattgccttctgcgccctgaccctgctgcccttccatgggagctgaaaagcaagctgctcagaaggaaatggcttttgttatttaacctgaataagtgtcaccatgtgccttctctggaaatctactcatggctgaagagggggaccagggttaccctagtgtcctttgttttgttaggggcctaaagcagaagcaaaggcaaccctcatgtataccactgcttttgtccccacttcctttccaaacactgatcttaaccctattcccctaaaacatagctgataaatgataaatattcaggcccttgcctggcattgcaagctacaaacaagctggtctcaagcagcctttccagtcttgtgacccaccacttccttatacaatcctcactttcctggtggccagaatacccaccatgccctaaacgctcctggctttctggcctccttgttcctcccacctctgcctattaagcaacttcgtgaagtaggaacgagctcacatccgaagcgccggagagagtggcatgcctaccagcctcatcttctatgtgcttcagtttccttctctctcgaatgtgcctgatggtgtagcccacttaccttgtcaaatggttgtgatgagattgaatgctatgaaaaacccttagtaaaatgtgaaacaccatccaaatgctgttttgtattggtaaaggaaaatgacccatcctttagggctcagctcaatggcacctcccccgtgaagtctcccctgattccctggagagagtgatcactctctctttgtgcagtgctgtagcacttggtggttcttggtggtatgcatcactttttgcccagcacgagagttatttgtgtccaagtttgcctattctgtcttcaaggccgggagtttatgtggagggcagagaagtgcttaggcatctttgtttcccactaggcctagcccacacgtctcaaaaagcacttattgaactggggaggcaaaaaacaaagtcaattctttgacctggaagctcatctgagtccatgtatgtctcctctgggagctgtgagaggagggaaaatgacagaggatggggtggggagggtaggatggctgtagagggaagtgatgggaagctttcgaatgacttaaattgacttttttttttttttagttttcattcaattctgaccacatgtttcccatgaatccttagggagaaggaagtcagaaagttagtccttcgcctctccctggctcgccctggagtaccacatggatgagccaaagagcaggacagcctgaggaacttgcctcgtgggcctcacgctctgtagcaactcagaggcagagagaagctcctgggaggccccatatgtgacagcttctaaggaagctgcttgtggtgcatccatgaaacagggtggaacaactgctgattttgaacaacaaagctacttggaggccacattagactcagaccctgctcaacatttgggttctccccaccccgctcttcttttacattattgaggtaaaattggcattcactaaatggcacatatttgaagtatacaggttgatgagtttgatcatatgtatgcacctgtgaaaccattactacaatcaagataatgaatatttccatcacccctaaaagtttccccttattgatcacctttaatctttcttcatagcctaagtaagggaagaacatggttttattgttgatgggttattcttatgttagaaaactatcaggagcagtggccttggggacctgagtccaacttaaccctctgtgagcctcagtttgtccatcaataaaatgggatagttggacaaaaaaattgctaaggtttcctgtcagtctgagtgacaggacctttctatgatacaacctttctaaacagcaatttttaaaaaacataaaagaagtgtaatctactttgctttctcatgcccccaagttacattctggcagggtcatggctgatggtcagagtgatgtcgggttctgagggttctgggtggattattaactacattttacagatgagaaaacaggctaagaaagaagagaagatcggctcaaagttacacagccaacacgtaactgagctgggatgcaaatccagcagtgactcctaatctaatgttctttgcactgccccacactccattcccaagaatacaggcctagttccatgttgctgtcatgactaagggtccttgcatccaacagatagttctactttcctcctggtttaatctggggaccatagttcacctcctcagatctctggtaggtaaggaggcaagagaggaggctcccctgccctcctaaatcagaccaaatcaggccacagaacaggagtcttaagttttcttagactggaggtttccagaaagcagacgctctctgggcatgtaattcattgtattcagcctcctagtaccaggtacggacaaatgttcagtaaaccccatggcgggaacacaaggtcagcaggacaggatagaaatcttgggattaggagggacctctacctggcactttgcctcatgtttgccctggggtacaatcccccaaggggacctgttatgggctggggttggggcagtgctgggctgagctgagttgcacacagtcattatggtgtgagcacgtgccccaacagtgcagtggcacgatctcggctcactgcgagctccgcctcccgggttcacgccattctcctgcctcagcctcctgagtagctgggactacaggtgcccaccaccgtgctcagctaattttttgtatttttagtagagatggggtttcaccgtgttagccaggatggtctcgatctcctgacctcgtgatccgcctgacttggcctcccaaagtgctgggattacaggtgtgagccacaacagctgcatcttttataactccctggaggaagggaggggggccagttactttccctgccctttttttcagacccccagtcggcctactgtgcctcagcgtaaggtaggaaagagtgcctccatggggaatttgtggtggtagcagggttctgagcagacccagggtgtttactccctgagtactcaggaagtacccagagtaggtgctcagtaaatatctgctgactgactgaatgaactctaactccatgtcaagcactgtagggggtacaacgatgaattggcctccatccctgactgtagcagagaaagagggataagacaagcacataaataactgttacacacgacagaatgtgataaatgccttgggagatgaacagccaattgctcaaagagcttggaggagggacgctcacatctggcaatggtggggggaagggactctagagaaaacttcctgcttgaggtgacattcgagctggttttgaatagggacggggtttctacagtggctcaggaatgtttgtgtggtgggggtggggagtcaaggcaggctgcattccaggccccagcagcagacttagggccagaagtctcccttagtatatcctcagagagcacagagaactgcaaatcagtgatagtcctagagcctcactataactgcgtgttttcaacctccatcccaccatgccttgatttgagaccccctacaagtggccaaatggacttagctgggctgcttgctggctcatgggctagctagcccaaaccagaagtgagagccagtcctggtggccttgcagacatttcctcatgaaagcctttcttcccagctcagctcttatctgggaacaataaaggtcctcaactctgggagaaggccatgcagggaacaatagtttctggctcacttcatccatcattcatgtggctcagatagaccattgctgagcagcagtggggacgagttgggggagggggagggcacattattttgcatgagattgttcattgggctgccccaaaactacacagtggggaattgggtagcgacattcctgggtgtgctatacataggcatgagcctgggcatataatccagccctttctcttctctctgcctctttgtttcctaatttctgtccagaggcagttggttgctgttaactggtaaactgaatggtttcactggacatgggacaagatattggattcatttcagcagatattttcaaatatattatctcattgaatcttcaaaacaattttataagttggaattattattttcactttacagatgaggaaactgagggccagagaagttaagcaactgccaaggatgcagataggaaggtgaaattggatatcaggactcctaactgcaagtgacctcagctgtacagtctgaaggctggcagttacaaattagttgcaaacgatccagggactgaacaaaggagaaaaaaggggaaatgcgagagttaggcagctaccagttaggcaacctattctccttgtgccaccatgaagaataagttgatcaagggtggaaaagaaaactcagggcttcaattccagtatggaggggtctagaagtctccagaggataggaaagaggatggagatggagcccccactcatctggctcttgcctgcccagggtgctacagcgatgcagccacagcctgtcggctctgttcacctctttaaggttgatgtcagccaaaggcagcccccagagagggaccacttatcctgaacaaatttatcgtatgaatatttgttaatgtatacaacagtaagagtcttactagtatatttctgaaacagatttataccaaaaattagtctggttttaattaaagtattttaacagctttttaaaaaagatgtaatttaaataccacaaagttcacccatttaaagtgtacaatttaatggtttttattatatttaaagaattgtgcaatcatcactacaatcaattttaaagattttcagcttcaaacccccaaatcaatattgtaccctcaagctgtgaccccccaatccctcagcctctcttactcctccactccccagtactaggaaacgtctaatctactttttgtctctagagatttacctactctggacatttcatataaacgatattatatgtcttctttttaaaatagcttcttttacttaacatacggttttttgagatttatccatgttgtaagatgtatcaatatatcattctcttttttttgtggaaagatattcaattatatggatataccatgttttgtttacccattcatcagttgatagacctttacattgacaagtatttttgcggagcctaggagtggaatttctgggtcatatgctaactctatgtttaaccttttgaggaactgccagactgttttccaaagtggctataccatctctccacatcctcatcaatacttgttctgcaatgttgtcttgcttataaccatcccagtgagtgtgaagtggtatctcattatacttttaatttgcatttccttaatgactcatgatgttaaacatcttttgatgtgttagttggcactttgtatattttctttggagaaatatcttttcaaatcctttgcccatttgtaattgggtgatttgtctttttattgttgagttataattattcttgatatattctggatactaggcccttatcagatatctgatttacaaatattttctcccattctgagttgtcctttcactctcttgatattatctactaatgctcaaaagtttttaatttttatgaagtcaaatttatagctactatgtatttcttttgttgcttatgctttttacttcttttgttgcttatgcttttggtattatatctaagaaagcattgccaaatccaagatcatgatgattgactcctatattttcttctaagaaatttattggtttagttcttacgttttggtctttgatccatttctcttttattagggtaggaatccaactttatccttttgcatgtggctatccagttgtcccagcaccatttgttgaagagactgttcttttcccattgaatggtgttgacactcttgtagaaaatcaattttctgtagatgcatgggtttatttcttcactgtccaatttattccatttgtttatgtctttctttatgccagtaccatatggttttgattactgtagctttgtagtataactagaaatctggaagtgtgtgtcttccaactgtgctcttcttttctaagagtaatttgtctatttggggtctgttggaagaccatgtgaattttagaattggctcttccatttatgcaaaaagggatattgggattttaatgggaattgcattaaatttgtagattgttttcggtagtattgacatcttaacaatactaagtcttccagtccatgaacttagactgtatttctgtttatttatttaggcttctttaatttatttcagcattgttttgtaattttcagtgtatgaatcttgtacctccttggttaaacttattcataagtattttattctttttgatgctattgtaagtggaattgttttcttaatgtcatttttgattgtttattgataatgtatagaagtacaactgattttaacatattgatcttgtaccctgcaactttgctgaattcatttattagctcaatagtttttctaggattttgtatatataagatcatgtcatatgtgaatagagatagttttactatttcttccttaactatgtgaatgaatttttccttccttctgttcttctttcctttcttctgtactttcttcctccctccctccctccctctctccctcccttcctcccttccttcctcccgccctcccttcctttctttattccttgtttttcatttattttatttttgcctgaatgctctgtctagacgttccaatacagtattgaatagaagtgtcaagagagggcatccttgttttgttcctgatttaaggaggaaagctttcagtcttttaccattgaatacgatgttagctttgggtaggtttttattttatgcctcttaccgtgttttttgtttgatttttgtttttgagacagaggctcactatgttgcccaggctggagtgcggtgccacgatgatctcagctcactacaacctccgcctcctgagttcaagcgattctcatgcctctgcctcccgagtagctgagattacaggcatgcaccaccatgtccagctaatttttgtatttttagtagagacaagattttgccatggtggccaggctggtctcgaactcctggccttaagtgatctgcctgcctcagccttccaaaatgctgggattacaggcatgagccagtgtgcccggccatttatcctgttttgaaaattcccttgttttcctcatttgctgagtgttttattatgaaaggtgtgaattttgttttttgtttgttttgcttcattttcaaatgatcatgtggtctttttcctttattttattaatatgacatatttcagtgattgattttcatatgttaaaccacccttactttcctgggataaatcctaattggccatggcatatattcttttaatatgctgctattgaattcagcctgctaattttttcttgagaatttttacatttatataagggatattgatctgtagttccttttcttgtgatatctttggctttgatatcagggcaatgctgccctcagagaataagttaggaagtgttccctcctcttcaatattctgaagagtttcagaagaattggtatcaattattccttagatattttgtagaattcaccagtgtagccatctgatcttggacttttctttattgggagatttttttattactgattcaatgtctttatttgttataggtctattcagattttctatatcttgagttcattttggtagtgtttttgtttctaggaacttggttctcttataatttttttaaaatttctgtaaggttggtagcaatgtccccactttcatctctttccttttttttttttttttttttgagaccagatctcactctgtcacccaagctagagtgcagtgacaccatgatagctcactgcacactcgatctcttgggcttagacagtcttgttgcctcagtcttctgagtagctgggactacaggcatgtgccactatgcctggctaattttttttttatttaattttttgtagagaccaggtcttgctatgttgctgaggctggtctctaactcctggcctcaagtgatcctcctgcctcagcctctcaaagcattgggattacaagcatgagccaccatgcccatcccctacttgcatttctgattttagtaacttgtgtcttctctttttttttccttggtcagtctagctagagatttgtcaattttgttaatcttgtcaaataaccaactgtcaagtcattgatttcctccatttttttctattctctacttcatttacctctactctttgttacttccttccttctgctagttttgagtttagtttcctcttatttttctggcgtcttgaggtgtaaagttgatcttctccctggttctgtccattattgaaagtggtaaattaatctgtttatggtaagccctagagcaacagttaatatgtaaataatatagtaaaatatttatttttattattcaaaataattttaaaaatcaaagtgctatgatagaaaacattcacttaatgcaaggaaagcataaaggaggaatagagaataaaaagctatgagacatataaaaacaaaaaataaaatggcaaatgtaaactcaattatatcaatagtaatcatgatattaaatataaatgaattaaacaatccaatcaagaggtagagattgtcacacaggatccaaaaaacagtgtaacagtataactacatgctgtctctaggagacactctttaaattcaaagatacaaatagattgaaagtaaaaggatggaaaaagatatgtcatgcaaacagcaacctcaagaaaggtggaatggaccaggtgcagtggctcacacttgcaattccagcactttgggaggccgaggtgggaggatcacttgaaaccaggagtttgagaccaacttgggcaacatggggagaccccagctctacaaaaaataaaaaattagccaggcatggttgcacactcctatagtccaagctatttgggaggctgaggtaggaggatcacttgagcccagaaggttgaggctgcagtgagccatgatcatgccactgcactctagcctgggcaacagagtgagaccttgtctctaaaaagaaagagaaaggtggagtggctatatatatacacatatatatatacatatatatatatatatatgtatatacatatatatatgtatatatatatatgtgtatatatatatatatgtatatatatatatgtgtatatatatattattattattatactttaagttctgggttacatgtgcagaacatgcagttttgttacataggtatacacatgccatggtggtttgctgcacccatcaacccatcacctacattagttatttctcctaatgttatccctcccctagccccccacccccaacaggccctggtgtgtgatgttcccctccctgtgtccatgtgttctcattgttcaactcccacttatgagtgggaacatgcagtgtttggttttctgatcttgtgatagtttgctgagaatgatggtttccagcttcatccatgtccctgcaaaggacatgaactcatccttttttatggctgcatagtattccatggtgtatatgtgccacattttcttaaaacccaaaatcctgtgttttgacagggctctctttgactgaacacagccagctgttaaaccccactaattgctggctgattgttctattgttttcaaaaatccttaagggcctaaattgttccaaaaactggtccaatcaaattctggcacctttgaagcatagttccctagatcagtatttgagatttgttctgataccaggagggctcttctcagctgtctcttctctgtttctctccagtgaactagccagcttacagttaagcctgtatctccaatgaatatattattctcctaccaattaccttttgccacagtctccactgtttttgagaacatctccaaactcttacatctttcattctcttgatggtgtctttcacagaacagaatttttaattttaatgagtccagtttattaactattttttttcatggattgtgcctttggtgttgtatctaaaaagtcattgcaatgtaagttcataaattttaacaaatgtaccactctggtgcaggatgttgatagtggaggagattggttgcatgtatatggagacagggagtgtaggaggtatatggaaactctgtactttctactcaatttttctatgaacctaaaactgctctaaaaaaattttattaatttaagaaaagtttaaatccctagatgaagataaggtgtcaaaattacaaatagactaataatcgaagttttcaaaaagccatcaccatacaccaggtcatttacatgttctctctcgtgttattgtctgggagttttatagttttgcattttacatttaggtctgtgatccattttgagttaacttttgtaaagagtataaagtcaatgtctagatctatttcttttgcatgtggatgtccacttgctcctgcaacatttgttgaaaagactatttttgctccattgttttacctttgctattttgtcaaagatcagttgagtatatgagagtatatttctgtgccttttattctgttccattgatctacttgtctgttcatttaccaataacacactgttttgattcctgcagctttatagtaagtctcaaggttgggcagtgtaagtccttcaactcttcttctccttcaatattgaggcggttattccatgtcttttacctctccatataaactttagaatcagtttgttgatatccacaaaataacttgctgggattttgattggaattgtattgaatccatagatcaagttgggaagaactgacatcttgacaatgttgagttttactattcatgaacgtagactatctccccatttatttagttatttgatttctttcatcatagttttgtagttttcctcacacagatcttgtacagatgatattagatttataccaaaatatttcattttctgtgaatgctaatataaacagtaatttttaaaaacactttattgatgtatgacatacaaaaagctgtgcatatttaatacacgcaacttgatgagtttgagataaatatacaccaaacatatggaatgcttcgcaaatttgcatgtcatccttgcacagaggccatgctaatcttctctgtattgtttcaattttagtatatgtgctactgaagcaaacataatactaatgaatttttaatttcaaattccacttgttcattgctggtatatagcaccgcaattgactttgtatattaaccttgtgtcctgcaaccttgtataattgcttattagttctaggagtttatttattgattctttcagattttctgcatagatgatcatgtcatctgtgaacacagacagttttatttcttccttcccaatctatttaccttttatttctcattgcattacctaggccttccagtaaaatgttgagaagcaagtggtgagaggggacatccttgccttgttctttgggaaagtttcaaatttctcaccattaagtatgatgttagccataggttttgtgtagatgctctttataaagttgaggatatcctttctatttctagtttgctaagagtttttatcatgaatgagtgctggcatttttgtcaaaagctttttctgcatctatagatacaatcgctatttttctttactagcctattgatgtgattgattacattatttgattcttgaatcttgaaccagcctttcatgcctggggtaaatcccacttggttgtgatgtataattatttttatacattgctggattcaatttgctaatattttgtcgaggatttttgcatctatatttatgagaaatattggtctgtggttttcttttctcgttatgacttcatctgattttggtctttgggtaatgctggcttcacagaatgagttaggaagtgttccttctgcttctatcttctaaaccagattgtagagaattggtataaattttccttaaatgtttgacagatttcaccagtgaacccatctgaacttggtgctttctgttttgaaaggttattaattactgatttaatttatttaatagatatatgactattcagattatcaatttctttttgtgtaagctttggcaaactgtgtcattcaaggaattggttcatttcatctagtctattgaatttgtgggcatagagttgttctttgtattcttttattattcttttggtgtccatggaatttgtactgatgttcccccctctttcatttgtaatattagtcatttgtgttctctttttttcttagcctagctagaggcttattgattttattgatcttttaaaagaagcagcttttggttttgttgattttttctccaatgattttctgcttttggtttcattgatttctgccctaatttttatttcttttcttctgcttactttgggtttagttcgctttttcttctattttccaaaggtggaagcttaggtttttcttcttttctaatatatacattcttcatttctaatatgtacatgctataaatttccttctaagcactgcttttgctgcatccctcaaattttgatatattttcattttcatttagttcaatatattttgtatttctcttgagattttttctttgatccatgttttatttagaaatatattgtttaatctccaagtatttcaggattttctagacgtctttctgttattgatttctatttcaattccattgtagtctgagagcagacattatatgattgctattcctttaaacttgtaaaagtgtgttttatggcccataaaaaagtattaactgttgtcagatttatcctcactgagcatccaacaattcatcaattacaattcaggttttcctactccagtactgatttctgttcatgagtttctcttcccatgagttgtgattctctgtgttcatctgtctgtctctaattttgagggcagaggtttgccctgtgacctcatttctctgattaatctaagaagaggtattgatttttcagtgtgttcagctttttacttgttaggatggggagcgacttctaagctgcgtgcatgttaaccggaagtcaatctttttttttttttttaagagacagggtctctgccccattgtccaggctggagtgcagtggtacaatcatagctcattgtaacctcatattcttgggctcaagcaatgttcctgcctcagcctccctagtatctgggaccacaggcacacaccaccatgcctggctaatttatttaattttttgtagagatgggggtcttactatgttgcacaggctggtctggaactcctggcctcaagcagtcctcctaccttggcctcccaaagtgctgggatgacaaagagcagtggcatgagccactgctcttcacactgtcatgcttgaagtggaacctgccacttcatttcatactgctgaataatattccattccatcttatagctataccacattttatttatccatttactagttgatacacatttgtgctgtttctactttttggatattatgaataatgctgcaataaatatttatgtaatgtgagctctttctgcccttttttgtatggcatcctttgatgcacaaaaatttttcaccttgattaagtttaacttgtcaatctttttttttgcttgtgtttttggtgtcatatgtaggaaatcattgcctaacccaatatcatgcagattttcttccatgttttattctaagagttttatagttttagcttttacatttagtctataatcttctttaatttttgtgtataatctcagatagaggtcctactttattcctttgcatgtggctatccagttgttcagaattatttgttaaaaagacttttctttccccatttaattatcttgatatctttgtcaaaaatcagttgaccataattttagggtttctttatcatctcttgcttattcagttgatctaaatatctagtcttgtgctagcaccatgcagtcttgattattgtagctttgtggtaagttttgatattggaaagtataaatcccccaagtttgctgttctttttcaagaacattttggctattctgagcccctttcatttccatatggattgtaggatcagcttgtcaacttctgccaaaaaagatagctgggattttcacagggattgtgttgaatctgtagataaatttgggccatgtagctatcttaacaatattaaattttctgatatatgaacatgagatgttttcccatttatttatatcttttaagattttttcaaccatgttttctagttttcgaagtaagaaatttttacttcttttgttaaatttatccctcctttttttttatgcttttgtaagttgaacggttttctttttttcttttttttttttctttttttttttttgagacagtctcgctctgttgcccaggctggagtgcaatggcgcaatcttggttcactgcaacctccaccgcctgggttcaagcgattctcctgcttcagcctccccagtagctgggattacaggcacccaccactgcgcatggctaatttttgtatttttagtagagacggggtttccccatgttggccaggctggtttcgaactcctgacctcaggtgatccactcgcttcagcctctcaaagtgctgggattacaggcgtgagccatcacgtccggccaaatggttttcttaatttcatttagcaaacttgttgaatttgtttattaattctcatagatttttagtggtttccttaggattttctatatacaaggtcatattatctacaaatagagatagttttacttcttcctttttaatctgtatgccttttgtttctttttctttttaaactaattgctctagctagaacctccattacaatgctgaacagaggtagtgagaacaaacacccttgtcttagggaaaagctttctgtttttcaccattaagtatggtattggctgtgggtttttcgtagatgcatttatcaggttgggatgtttccttctatttctagtatgttgagtgtttttatcataaacaggtgttagattttgtcagatagttttctgcatctgttgaaatcagcgtgtggttttggccctttattctaatgatttttaattcattttcagatgttaaaccaacttaaaattcctgggataaatctcttttgttcatgtataatcttttttatatatagctatatttgatctgctagtgttttgttgaggactttgcatctatatttataaggcctgtaggtttcttttcttgtgatgtccttttctggctttggtatcagaataatgctggcctcacagaatgagtctggaaatgtttgtttcttccccgtttttggaagagtttgtgaatttttctttaaatgttttgtagaattcatcagtaaagccatctgggcctggacttttttatgggaagttttaaaattattaattcagtctctttgtttgttataagtctattcggattttctatttcttcttgggtcagttgctagaagctgttctttctaggaatttgtctattttatctaagttaccgaatttgttgccatatagttgttcatagtatttgtttatttctctttttatttctgtaaggtcagtagtgatgagtcttttctagttttctttttgtcagtctagttaaagatttgttaattttgttcttttttttttttcaaataaccaacttttggtttctttaattttctctacttttctaatatttatttcatttatttcctcttttattatttccttccttcttcttgctttgaatttagtttgcttttctttcactcgttccttaagccatttttgctttttgaattttctcttgtaaagagtatcactctgtcacccaggctggagtgcagtggtgcagtcattgctaactgcagcctccaactcctgggctcaagcaatcctcctgcctcagcctccctagtagttaggactacaggtgtgcgccaccatgctgggttaattttttaattttttgtagagccacggtcttgctatattgcccagcctagtctcaaactcctggcctgaagtgatcttcctgcttcagcctcagttttgctttttgttttctatatgtttcacatcttttttttttaacctctgttcctcttttactgccttgttttgcattaagtattttctagtgtagcattttaattcatttaattattttttaactttttaaaaaagtttttttcttaattgttatcctaaggtttatgatatacaccttaacttgtcagaatctacttcagatttgtagtaagttaattccagtgagacacagaaactttatttttatatagctcccttccccatttttgtgctattgttattatatgtattatgtccatgtgtgttacaaatctaacaacacttggttacagttattactttatgtaatcttatgtcttttaaagaagctaatagaagaaaagagagcatggatatatttatagagtttaaaaaatactaaccttcttaattaccattgctggttctcttcatttgttcctgtggatttgagttaccatctagtgtcatttccttattccagtgcagctctgttcccaacaacctcctttaccctattgttgtcaaatatattatatttttatatattttatggaaaacaatgcaattttatagatattgtttatgaaattgctttctaaattatttaagaaaataggaaaaatatgtaattattcttatatcattacctacataactacctttactggagctctttggttatttgtgcgaatttaaattgctgtctcagccaggtgtagtggcatgcacctgtagtcccagctgctttggatactgaggcaggaggatggttttagcccaggagtttgaggctgcattgagctatgattatcccactgcattccatcctgggcaacagagcgagcccccatctcttaaaaaaattgctatctaatgtcactcccttttagcctgagaaacttcctttagtgttttctgtaagtgacaatggattcacttagtatttgtttctatgggaatgtctttattttacttttttttttttctgagatggagtttcactcttgtttccaggctggagtgcaatggtatgatctcggcttactgcaacctccacctcccaggttcaagcgattttcttgcctcagcctcccaagtagctgggattacaggtgcgtgccaccatgcctggctaatttttgtatttttagtagagacggggtttcaccatgttggccaggctggtctcaaactcctgacctcaggtgatctgccctccttggcctcccaaagtgctgggattaaaggcatgagccaccgcgcccggcctattttgctttcatttttaaatgatagttatgctgggcttaagggttgacagtttgtctgtttgtttgtttactttctgcattttgaatatgtcatctcaataccttctgctctccgctgtttctgttgagaagttagctgttaatcttattgaggtttccttgtacatgatggataagttaagtgtttcctcctgctttcaaaattttctctttgtctttcaatacttcattatttcagcaactgtgatacatctgggcgtggatctctttgtctttatcctgctagaagttcattgagcttattagatgtgcatattaatgtttttaatcaaatttgagttgtttgaagccagtatttcattaaatattttgtctgtccctatctctgtcatctctccttctggtactaccactatgtatgtaatatgttggtgcacttaatgctgtcttacacttctctgaggctctgttcattttgttgttgttgttgttcttcagactgaaaaatctctattgcctatctttattgttgtgtgtgtgtgtgtgtgtgtgtgtgtgtgtgtgtttggcttggagactgctttcacaggtcaagaagtttacaattttgctccatgttcaacaagaactattactttagttttctctccagtcattcctgagagggcctagtcttaggcatatgtacagtctttcagacctccaaggatgagtgtgatttaattttaagcctggctgcctaggagtgggccctggtttagggtagcttattgttcagtcagtgatttgtcacaggttgtgagccagtaaggctgtcctttgttgcttgaattgtgtgtggcttgaggaatgttttgcagtctgtcccacgtcctgccttgattgctcctgaagtaggtgcagcctagtgcatgtgcacagccttccaagtccatagggatgagtatgatcccatgaggtgtcttcttagctgtttctttccatggttttctctggcaaccttctggctggtctgccatttttcttgttgctactagtttcatgaagctaccagccgtcttaactgcttgccgtgaagatctccattgttttcgacagtgccctcaggcatgaacttctccatgctctgttctaaataacgagcccccttaggacagaactgtggagctctccatccttaaggcttgccttcagggtctgcctctaagccactgccctggagctgggggtggggagagttcctggttctcctggagtgacaccccttactctaagagtgggtactggggaggtggggaggggataggagtccctgatcttctcagcttgcctctcccagtatggagcttgcatcctattagccagctgtggtaggatgattgaggcctagcattcttggcccgttgtgcctggggtaaagattctgccctacaagctgggactgggtgggagaaggaagcccagtcctcttggccactttcacccagaatagaacttctgcaatactgagctgggagagatgagacatgctcctggagtgaagctgaaacccgtagacttggagctggggaaatagagaaccttgctttcttggccacacccatccagaacagcgcttctgtaacatggagctggtgaggggcagaactggagcaggtcatggctcagatgtcacagactgtatctgttcttaccaatatttagtagattttcttgaataaatgtttctccacttactgtgtgctctgaggaaaatttccagagactttaaatggttatttaaaaaactttcaccagcgaaatgattgtttcactgaggaaaagcatctacttccaacacagccattctgtaagtcctgtccccttactgaaaattgtgacagtggaaaaaaattttttggtgtgggcttctctgtatatcatctctactagaactcaattaagcccaaactcaagattttattcaggaggaaagaaagcatatagaacagtgaaatggtgttacaatgtgaggcttactttaaaaaaaataaagagtttcagacttatcacataaatgttgacgttttgcaaagtagctattctccagaataaggcattaatcagaaggggaaacagtagtaattatgtgtaaaacattctgatccctggagcagcagaaataatctcatccctgggaacccttgtgggttaagtagggccttctctgctgttgctccagctatggttttgatatttctttctaattttttatagagaaaaactatcatcagtaaatattggcaagagcacgcaaaatagcccctcatctggtctctagaaacatacaggctgggtccacaaatgcagaaaagcagattgtgacattgctgtgactttgaactgctttagtgatcccttccatgctgactgttggcaaaagctcgttttccttctctctgccttgctttctccctccctgaacaatagcaaggctgtggaactcctaccttaatggaaagtgtgatagcgctgtgccactgggacagatacctcctttggatttgataccctctcctcaattgtatctcttcttagcctgctcatccccaccattttatcaatggaatagtcaattttaaagaagtatgggactccaaagagaagattcagccatggcagctgtcacttctcttcccccttgttcagcctgtttgtgtcttgtttgtggacatccactgctccttagtgcctaaagctggcaacctcatatgctggccgcaggactactgggctggagaggcagataccaacccatctgtgccctggcgacactccgctatttgcctttgcaagagaagttcacaccgaggagtgactgctggagacaattaccaccacagtggtgacctggcctttcagtttcttaccctgaactcctctgatttactctctccatcattcatacacccatttttatcaagatatcactctttaaatctctgttgggagcacaacctctctcctcccacagcttcccagcacacctgcagtatggtctcttggcttttgcccaaacatttgtattttagacactgcttctccacaccccacacttgtctctccgtctctctcttcctttcccctctctccccatcagtaaatgctttcaattgcttctctaaagagcctataccccgtgataccctcctttccttgaccttagacccttcttattatgacaattattatctccaggcccattccctgccccttcccctggctgttttctctcctcctcctgttggctctgagcttgctttctttatagtgatggtactttttttctctcccaaactagctccttcctcatcaccattcctcccagcatcctggtttgcagcagtcaggtgaaagagagaagcaggtcccggagggtcttggggcatgtccctctctgtctcagggagaaagctgctgctggccctaccactagtatcctgtgagaataacagcccagtgctgccagaacctataggtcttcaagagaagatagaaactccagattttaatgtaaactgtctcacttttaaatgttgaaaactattctttttttccccaagaacctggggaaagtagcaaaaccccccacatctctgggctagatttaactcccctatctcccacattaactcagttgcccagttctggaaagctgcctgctaaggacatatcctccatttcactggcccactgtggtccctgcctttaagccttgtcacctggatgactataatggccacctaactggtctctctgcttcatgcccctccccgcccagtctactgtatacaacataattgcctcaaaataacagagtcttgtggtgaagggcttgtactctgggatctggctgtgtagatttagtcccagctgccatttataagctaggtaatcttgggcaagttagttcacctttctgaatctctgtttccttacctgcaaaataggaaaaatagttatacctcctcataggcctgttgtgaggacttagtaagcctgttgtgaggacttagtaaagaaccatgcctaagctggaataagtactcaataaatgttaaacaaaattgtgtcatcccctgttgcaaagacctccaaaggctccaatgcctcttaaatacagtttagcccctttgtctagacattcaagaccctcttgatctggcttcagccacactaggctcctgtcttattaatttttttctcccctgcagtgctatatgttctcactacctctacactttcatcccccgcagtaacctgtgaggcagctgctatgattatcctcatttcacagatgagcaaactgaggctaagtgtcctgcccaaggcctcccgacctggaagtggaggaagcaggatttgactccagatctgtctgactaaagcctgttgtctttccactagaccgtagagagggaaaaacacacagtgacaggaagacatgagagagacttgcgattcacttctccctagggaaaaccacagagcattgttttttctccatgagaaaccaatctgaaagagtggtgtaaccatgtgagaatgatacggggtgggttggggccaggatatgctgatgcttgtgaaaactgctgaagtcagcacaagggacttttaaaactagatttagaacaagttgcaaagcaagaaaggattggccagctgctttggggccaacagggtaatattactttttggctccttttgtaacaggtgtggttaagctctcccttaaaggctttggcaagatgaggttagcatagcagttaggtgccccagatggagaaacagaattctcaggttcaaatctccattttgccacttaaatctgtgtaaccttggaaatgttatgtctcgttttctcatctgtaaagtggcagataataataacacctacctcacagggttgttgtgatgattaaataaaatagtacatgaaagctctcagaacattgcctcacacacagtaagttattttataaacagtagctagtatttgtccttcatgaatatatgtgctcaaacttggtggcagtctctctctctcttttttttttttttttgacagcgcctcactttgtcattcaggctggagtgcagtggcacaatcttgacttactgcagtctcaacctcctgggctcaagtgatcctcccacctcagccccccagtagctgggactacaggtgtgtgccaccatgcccagctaattttttgtagagacaggctttcgtcatgttgcttagcctggtctcaaattcccgagctcaagcgatccaccctcctcggcctcccagagtgcgaggattacaggcatgagccaccgcgcctgtctggtctctcttctttcttgacctattccaaaaaccaagaccatggccgcaccttctatttgtagacatttagaaactttccaaagtgctccagacacctcattaggaggatggtggaaagtttctgaaatcttaaacaactttctagaaggaggtgaccatactcttttatcccacctcccttattacatactgcttgcatttgtacagcccactagtataagtgcacagactctggagaggggtggcctgggttcagattccatccttgctacttactctctgtgtggccatgggaagttacctaacctcccttgacctcaattgtctcatgtgtaaaaaaaagagataagaataacaactctatcatggggttgttatgaggattaaacaaattaattcatctaaagtgcttagcgcagtacctaccacataagaagccttaatcaaagtagctgttctcattactattagaaaataaactaagaaatcattaggcatcccttaaacttctcttttaggttttcctttactagctagttctcacatcaccttacattctcagcccctgattagagcactcgcctttataagggaatcttggactgccgtcatatccctcccttggacctgccaacccctgcccttgggtggtgctttatacccaactgcagccataaggctctcatttggtgccaggactctgcacagaacagcttctgaggtaatcctccatagactgtcaagcccaaaaagccactcgctataggtccttaacctcattctgcataggactagaagaaagatgtttcccagccagacacactttattcagtcatggaggagttgaatggcacccctgcatcagatcagaagctgctggcacattcagtactgctattcaggctactgcttatatttctgttaggctggccctggccctggcatcatttagcctatcttgggctcacatcttttttttttttttttgagatgaaatctcctatatctgttgcctctcattttactacagaaacttgtcaaggtttttttttttttttttaattatactgtaagttttagggtacatgtgcacaacgtgcaggtttgttacacatgtatacatgtgccatgttggtgtgctgcacccattagctcgtcacttacattaggtatatctcctaatgctatccctccaccctccccccaccccacaacagtccccagtgtgtgatgtttcccttcctgtgtccaagtgttctcattgttcagttcccacctatgagtgagaacatgcggtgtttggttttttgtccttgcgatagtttgctgagaatgatggtttccagcttcatccatgtccctacaaaggacatcaactcgtcctttttatggctgcatagtattccatggtgtatatgtgccacattttcttaatccagtcgatcattgatggacatttgagttggttccaagtctttgctattgtgaatagtgccacagtaaacatacgtgtgcatgtgtgtttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacgtcctctccagcacctgttgtctcctgactttttaatgatcgccattctaactggtgtgagatggtatctcattgtggttttgatttgcatttctctgatggccagtgatgatgagcattttttcacatgtctgttggctgcataaatgtcttcttttgagaagtgtctgttcatatccttcacccactttttgatggggttgtttgtttttttcttgtaaatttgtttaagttctttgtagattctggatattagccctttgtcagataagtagattgcaaaaattttttcccattctgtaggttgcctgttcactctgatggtattttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaaaggatccagtttcagctttctacatatggctatccagttttcccagcaccatttattaaatagggaatcctttccccatttcttgtatttgtcaggtttgtcaaagatcagatggttgtagatgtgtggaattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgagctctaaagtagttttttccaattctgtgaagaaagtcattggtagcttgatggggatggcattgaatctgtaaattaccttgggcagtatggccattttcacgatattgattcttcctaaccatgaacatggaatgttcttccatttgtttgtgtcctcttttattttgttgttgggctcacatcttgcccaacatcagctgttgtcaacaacacctgtgctcatctaatcatttagctcaggtgtctcaagcactttttacatgccaaacagtgtgtgtgtgtgtgtgtggggtgtgtggggtgtgtgtgtgtgtgtgtgtgtgtgtgtgtgtgtgtgtagtgtgtgtacatatgtgcataaggataagttgaaagagtcaatgaacagaatgaagcctacttgcaatccagtgcagcactgtgagtctgggctttggagacagatgggcctgatgcaaatcctagctctgcttcttgtcagttgggcaatgtgggacaagttaatctgtcttactttgatcagctataaaaggaggatagtagaaagatataccgtgaagagttactgcaaaaataagaggtagcatatgtgagtgcctgatagagacctaatcaatgatttttgtaattattattttccctagacccaattctcaactagggtgttgccccttgaaattaaaaaggagaatctacatgcaaaaatgaataatttggactcctaaccttatatcatgtacaaaagttagctcaaagtggatcaacgacataactgtaagagctcaagctgtaaaaccgttagaagacagtgtagttgtatatctttgtaaccttgaatcaggcaatggtttcttagatataacaccaaaggcacaaaagacaaaagaaaaactaggtaaattgaactttatgaaaagtaaaaaactttgtgcttcagaggttaccaagaaagggaaaagacagcccaaagaatggacaaaagttttgtaaatcttatggccaggtacagtggctcacgccagtaatcccagcactttgggccaaggcgggtggatcacttgaggtcaggagttcaagaccaacatggcaaacatggcgaaaccccatctctttttaaaatacgaaaattagctgagtgtgttggcacacacctgtagtcccagctactcaggaggctgaggcacaagaattgtttgaacccaggttgcagtgagcagagatcgtgccactgcactccaacctgggcaacagagcaagactctgtctcaaaaaaaaaaaaaaaaaagaaggtttgcaaatcatatatctagtaaagaacttgtatccagaatatataaagaactcttaaaactcaacaataaaaagacaaacaactcaatttaaaaatgaacaaagatctgaatagacagttctccaaagaagatatacaaatggccaacaagtacatgaaaagatgttcaacatcattatccatgagggaaatttaaatcaaaccacatgagatcccacttcccacccaatagatttgttgtaatcaaacatacaaataataagtgttgacaaggatgtggagtgactggaaatctcaaataccactggtaggaacataaaatggtgcagcctctatggaaaacagtacagcagttacacaaaaggttaaacatatgacccaggttaccgtatgacccagtaattccactcttaggtacatactcaagagaaataaaagcatatgtccccataaaaaaaagcttgtacataaatgttcataggagcattatttgtaatagccaaaagatggaaacaacccaaatgtccttcaatgtgtgagtggataaacagttgtggtatattcatatgatggaaccagtcataaaaatgaatgaagtactgatatatgctacaacatggatgaaccttgaaaacactaggctaagcaaaagaagccagacacaaagcccatatactgtatgattccatttctataaaatgcccagattaggcaaatccataaagacagaaaatagactagttgttgccaggggctggagtggggaggataatagagagctaataagttagggtttcttttggggggtgtgatgttatgaaatatatatttggtctttgtctccatttcctggcatacaactccgaaaatccttggagtctccaaagtgatgtctttttgtatgcctatgagttgactgatggttgggtagcccaagaatagggactggtcactggaaagaccaaggcatgaatagagggttgggactttcagcccaacctccagggacgggagaggggctgaaggtgaagttgatcaccaatggccaatcatttaaacaatcatgcttacataatgaagcctccacaaaaactcaaaagaacagggtccagtgagcttctggatagctgaacacgtgaagattcatggagggtggcctacccaagtagaacatggaagttctgtgccccttcccacataccttccttgcttgatgcatctcttcatctgtatcattttttatgtcctttattatagaccagtaaatgtcagtaagtgcttccctgagttctgtgagctgctttagcaaattaatagaagaaaagagggggtaatgggaactccaatttgaagctggttgtccagaagttccagaggctagaacttgcaactggtgtgtgaagaaggggggacgcagtcttggggactgagccttcaacctgtgggatatgatgctatcttcaggtagatagtatcagaattgaactggaagacatctgtgtctactgtagaattgattgcttatttggcgaatggggagagaaaatcccacacatttggttacagaattttctgtgttgattgttgttgtggtgtgagaacagaggaaaaacagtttgtttttccactatcaccgggaaatgatctaaaattcactatgatgatgggtatacaactctgtgaatatactaaaaagccattgaattgtctgctttaattgattgaattatatgctacgcgaattatatctcagtataaattttgcttggtgctatgtctcacgctggtaatcccagcactttgggaggccgaagtgggaggattgcttgagcccaggacttcaagaccagcctgggcaacatagtgagaccccacctctacaaaaaaaaaaaaaattaaaattagccaagcctggtggcacacacctgaagttccagctactctggaggctgaggtgtggagattactctagcccaggagcttgagggtgcagtgagccatgatcacgccactgttctgtagcctaggcaacagagtgagaccctgtctctaaaaaaaaaataaaactgttaaaggaaaaaaaaggaatgagaaaggaactacccagagccaccacagtggacttgaaaaagttatggttatttcttgatgataagcttaacaaggggtggattattcatgcctcccctttttagaccttatagggtaacttcctgatgttgccatggcatttgtaaactgtcatggtgctggtgggaatgtagcagtgaggatgaccggaggtcactctcatcgccatcttggttttggtgggttttagccagcttctttactacagcctgttttatcagcaagggctttatgacctgtatcttgtgccgaccccctatctcatgctgtgactaagaaggcctaacttactgggaccgcagcccagcaggtctcatccttattttacccagcccctattcaagatggagttgctgtggttcaaacacctctgacatttcccccctcacttttataagagaacccttaatcctaagggttgcagagggacaaagatccatcttctaatgaatagcggtgatgatattcctgtctaactattagatctcttgcaatcagggtagagaggagctcagtcagaaagcattggtatgtcatgggccattcacaattctgagttctgacaaaaggtgatatcttgaagattaataagtattcaatgtaagaaaacattcggtaagcttatcctgcattcctacacaaagagtacaacagcaatatattccacaatagtaaagcaaaataagtaaaattgtccctagtaaactaaattagaaagctttccatgaactaggcatttgttggaaccaagctaatatggggttgctagccaatttcaatatgtgcccagaattggaatactgatccagatttttacattacccatccctcttgtttcttctgagaagcagtcagagatcactggatgattcacaggaataagcagagtcagtataaattgcagaaaaatacttaaaaacaactaatgagactaaaagctaataacaggtataccacaattcttgaaacataattttttctctctccagtctcccatttttactaaaggtaaatcatggtaagactgatttgctttattatacctggttggactgtttgtataaagtgcagcaagaataattatttttcacataagccctttttaaattggctttaatggagctctatttctttcctttttttttttttttgagatggagtcttgctctgtcgcccaggctggagtgcagtggcacgatctcggctcactgcaagctctgcctcccgggttcatgccatcctcctgcctcagcctcctgagtagctgggactacaggcacctgccaccatgcccggctaagtttttgtatttttagtagagatggggtttcactgtgttagccaggatggtgtcgatctcctgacctcgtggtccgcccaccttggcctcccaaagtgctgggattacaggcatgagccaccgtgcccggctgatggagctctgtttcatagatggaatctcagatctttttaaagccgagcccagccatggatttgtgccctcaaatacccataagttgagtaaatccctctccccttgaggtcccaagataacttggggctcctgggcctgtcagaaggtgacattctttaaacttaccacaggtcaggaaccttgtacaggaactgtgtagacaaggtatgaggccagtttcccaaggggcttttattggctctataagtcaagtttgattccttaaaggaaagcacaccattccattcaaagccttggtaaaataaccagtttctcaaattgtgtcctgttgcaaaagaaaacagattcttattgcacttatgcaaataactattgctataagttaagaacactcacaactagtttccaaattctggagaaatcaggtagagagaaacaaatatgctccaagttttattcccaggaatatactttactcaattgttaaaagctgtaaatagcttaaaagaaaagtttctttgactctgaaaaacaaaacaaaaggatccgcaatgctttaagctaagttaaaaaagattgcttcagtcttctattaggtcagtccattcagtcaactcctgttctgctttatattcatgaacatttcagctttccatgagtcttgaaagtttttcctctattctaatgtcataatctccaaagttattagaaacctgcattcaagaacacctgttagagtcctgtagctgattataaaccaccttttaaagaggatcaaaacaagacaacaattgcctgtggatgacaaaatgtcttagggcagccacagccaaaaacatgattgacaaagaaatttggttacctctacggcacacaatgattttatgtaataattataattattactgataatatatgctaagttatattaggattataagagtttcccataattttgaacacataccaataacatatttctagaaatacagcccaaaaaagccaaacaccatcttatatttgagaatgtttcctgtatgacttttataccaaataagccaaatgtcacttttggactttaggcaacctaatatctaaaagattaattaggtcagaaaaagtcatagtttataatttcactttggaaagcttatcaaatattaaaggcttaagtcacttgatattataaaaagaatcccaggtcaccgtaagtcactcatttaaccaaaatgataaatattttaaaaaggcaaaaccccatactcactaagagaggagagaatcagctttctaaacaagacccaataaagacagcatgaggccaattgaatcttgaatctgtcttttctttttcccctccctttttccctgccatttatccaaagtcatagacaaaaacctttcattatcttttcatattatgtaaaaatcttttttgaaacagaaaaccaaatttcatatttgcattagtgcatttttcatgccaaagctagttttaaataacattttataagtttatccagttttaattagtttgaccataaggtatgattttcataaacctcttataactctttataatttttgttaaacagatcaatcttctaagaaaaccctgttatttggacacgtgggcccaaattctggcaccaaatcagtatgcttttagtccaatgttcagtttatggaaaaactgaatacccctttaatttgagcgaatatgttcacacacagaatttcttttacaagattaatttttcacaaaccttccataacttgctcaaaccttcagctttatcttatctaacttaaaacaatccgttaaccctttaatctaggcaagaaaaaaaaatccacattcccatgcctttttataatcttttaccaaaaacacatttcactttctttacacactttgcatgtaaaactgtttctttaagctgggcgcggtgactcacgcctgtaatcccagctactcgggaggctgaggcatgagaatggtgtgaacccaagaggtggagcttgcagtgagctgagatcgcaccactgcactccagcctgggcgacagagcgagactccgtatcaaaaaaaaaagaaaaagaaaaactgtttctttagtagtctcaaatacgtgttacacggttaattcttagcaacttttacttttggtgaaaagcttggctagtaagccattgtagttaggtaccaggtctggagtctagaacatcagacagaagtacagataaaggctgactctttccagcatacgtagggggcatggctgtccatatgtccccaggccttatctagaatctaatgctccaaggtagtaggtaaattgaacaattttcaaaagtcaaagaagcagtttatgaccttaaagcatttagcaaagctagtatgtgaccgaatttagaccaaatgtctaaattttgaagacatttttattttaccagtaacctttaaaactgtttttatttcccaaagattactaaagtcacatgaaccaaaaggctttgtacttttacttttctgataaaatatttgatttaagctcttatttttaaaccaattaatcaaaacccttttatactacacacacaacacatatacatacacagacagacagaagataaaagagtcattccctaagccaggaattgaaccctgaagccaggccaccacggtgaagacacaaagccttagctactgagctacagcactgggaagtttccatttctcttcctagaaggagcctagaacagccaattttgaacttgcaaaagcttttaactgcttgagataattttaagggctaactataacatgaaaccccaaattcctgtccactggatgatggcaaccaagagaaagtactgccacgtggttacaaggttaagctcccaaggacatttttcaacatgtagtctctggcgagacagtcgccctgagtaacagacaagataagaaatggaaaagagagaaagaaagagagaaaaacattgctgcggcaggatggggaaggcgagttgctcacggaggccagagaaagatccacccattgcaatgccactgaaaagttcaggttttgttgaagggatcttttttgaaggttttgtttgtcaaagggatcttttccagcattcccatcagctctcaagtttccccctttagggaggaaaaagctccccatgtccaatgatcctgtatatacctaatcttgtcacctacagccatcagcaaaggcagattaattcaaagagaatagcagttaatagtagtgccaaactcgttcttagtcgagagggactttactgagagggatctccaaccccctaaatcttagaagggactctaacgctcctaagttgggcttctaacccaaggtcagtcaagcgtccttgacttttattaagaggggtctttaaccttctctgtcttaggagagacactaactcccctaaattgggcctctaactcaatcccatcttttacactggtaaatgcaccccacttacccaaagtcggccaactggtgctgcagactatttcctttgggttgggggtctcctcagtatcgttccttcagggtttgccagaaagatgttaccagaaaagggtccagatccagaccccaagagagagttcttggatctcgcgcaagaaagaatttggggtgagtccatagagtaaagtgaaagcaagtttattaagaaattgaaggaataggagaatggctactccataggcagagcagtctgtttaccaatttctggttatctgttgacttcctgccaagctagttaaagatttagcaccattgtctaactcatcactattttgtattcttttttggttaccccagtaagctatgcaatatactaacactttctatgtttttgttccatcaagtatgagctgcatcttttgagtccccacttggtaggctaaggtagtggcacccttcttcttcccctcagctctgtaccccacccacccttctcaccaggtggtgctttggcaaaacacttggtccttattttgaaagaccttgtctttaaaaatacaaaaaattagccgggcgtggtggcacgcgcctatagtgccagctactcgggaggctgaggcaggagaatggcgtgaacccgggaggcggaacttgcagtaagtcgagatcgctccactgcactccagcctgggcgacagagcaagactccgtctcaaaaaaaaaaaaaaaaaaaaggtggaagatgtgaaagataaaactaatttttattaagcatttactatgtgccaggaactatgcatgcatcatcacatttaatccttatcgtagtcctgggagggaaatatcataattgcaattttagaaatgagaaaactgtgaccagaccatgcatctggtagggggtcaagctgagatttgaagcaaagttgaatccaaagcccctactattttttccagagccccaagcatccttcaacttcagtttcatctgcagattttcaagtctcttttctgtagcgaaggcttggactagcagtctttagctatttttagaaccccacagtgattcctgctcattcaccaatgctgcagcctcttcccagagggcaaagaaaagggtgacttgagaggaacctgaaggcaaatgaaccatccctatggggtgtggggagagtagatcatctggatgggtttgctgattcagttgcatgcctggcaggcttctctctacctcgtggctcgggcattgagctttggaagccagtacagaagtcccacgtggtccctgaggtgacatgggaatcattttaccgcatcaccagggctccgcctgccagcatgctgcctttgatttgagaagcaaatacagaattttgaagattgtagctgactcagaccattgttctggcattgcggtcatagacacatgtgggaaattcccaaattgactttcccacagagctgctttggagtgggggacaaaaagagttcgggggcggagaatgtattttagttatttatttgattagtgcttgttaaatctttggactgtttcaactagaggcactgaatgggatttccccaggggtcacttctgggcatctagaagagtcaagaggtcaaaaggcccagactcaattttccatactgaggaaggagaggctaataacataaaacagacagtcccagattctttctattggtctacaggctgctgtcacagaaaaacatttggacgttcccacccacatactttcccccaacccatgtcctctgggttctccctctctgttggcgatccagccatccagcccacctaggagtcatcttcattctaccatctccttgcctcataacaacccttctccttcacccgtgggccaccccttctacacacacacacacccatacccaagaccaccccgctcacactgttgatttgcagggtcttacacattcaccctttctcctttcttgttagtgacctccaacctcatcacctcaggcctactactttctgtgcctccagttacacctcccacaacactggcctggccccaatccatcttgtcaacactgctagatgaatcttcctgcagaacagctttccaaggcctgctcagacttccccaaggcttctctgctgcttccagcataaaatccaaatgcctcagcctggttttcgagaccccattctacctgctctctatttctatttccaagctctgttcttgccacttccctactggactgagaacttcttgaagatgaagaacaagcctggctaactactggggctgtgacaggacaggagagtgtctaggacattgggagtcaggacctgtttgctgagggagtgaaggaatgaaagaatgagcgtggttaagccatcacaagactcattttgccaaatagttgtgcagggtcctctgtcactgaccagttgggtgaccttgaataagtcccttcctctttctgggcttcgtgtcttcaacaggtgtctcaaacttgcagctcttgggcccaaagggcctgcaaacatgttttgttggttggcacattaacgtgattttgaatgcctttctggaaagcgtgtgtgctgtggttccccactcttctcccattttcttacacctccccacctcccttattttcattagctgcttggtgcctaaaggcatttacatttgtgactcttggattaggtggtgtttactcacctttcaactctggcgtggctggaattctctgtttgacctgctttgaaatgaaaattgcaagtgctttgcttaagtgattcccagtgtcatctaatatacagcagtcaggccagactaactttgccttcccaaaacaggccaccaaagaacagtggaatatgccgttagtatttctgactttggcagtcagctgcagagggagattttattccattgaaaataattgtctttacatagcccagcacaagtggtgcccatttatagactagaaaggaccaagcacagcgtgcctattggcagccagctgggcctatacagagggcactggttgcaggcacaaagtgtgaatttagcccaagttgcctagcccagtcctttccagaacaaagtgctgaatgaggggtgtgtgctagaagcatttctctctctctgtctctctatgtctctctgtgtgtctttctctttctctctctctctctctctctctctctctctctgtctttggctgtcagtggcctagtttgcactaagactccatagagatacgcacagagggcagggaagatcaaggaggcattctcatcactgggttcctttgcattagccaggcccaagggccacatgagttgcagatctgcctggccacaggcaggcaaggcacagctcactgggagatgctagacaaacacagcagctgctggaaggcacttgcgtagtctggacagcaactgagtcccacacatttgggcagcatctgggtgaaaggtactgggaggtgggcagagagggctggtgtgggtgtatgtgcccatcactgggcatagtcaggcactgggtcaaagtggaagcactgatgacctgtggagccaaatggctgcagtcactgggtgtatgtagagcctgggtgtccccaaaatcagtgtggagggcgtagaggggctattcagttagggacacataataacatatccacctgtatgtagcagttgtaggcatctgagatagtgggtggggtggggaggtgaggaaggaaaaggggagaagaaagactgtttctgactaagctgtttcatgtgtccagaacaactgcagggagcttcctgggggaaaaagattgactatgtatctttgtctccctgtttctgccctttcctgctctgctgcttaggaactcagggagacaaagccctagtactgtttgtcaaagtcaaatagaatggataaagcaaactttccaaagaaactttatggaacacatttcaaagccctggagaagcaattttagggttttttgttttgtttctttctgtttttggttttctttgcatgactgccactaacttatgtcagcaaggcgttaagtgagacacttaagatcattgcggctgccaggggaagtgggtacacccgcttgtggggctgtaagacagcacagtcgctgaagggcattagagctgggctgggttgggctaggctgtggctgggactgaagaccgtgaacacagcgggacatgatgtggtgttggtatgactgtgggtgtgctgtgtgttatgtacatgtttgtgacagcactgagggacctggctgtagctgtagtgtgtggatttgttccgtgtagcttgaaaccagggtgctctggcagcgacaggaacaagtatgggccacaaagccagagagccccagtgtcagctagatgggaggggcgggaacttttctcaccttcatttccacatagccagctgggcctgtgtctctggcagtagttgctggtgtctgaaggcttttattccacctctaactggcctgcagtattccagctggaagccgtggaagcccacacattgacttgtgccgtttctggcacactcagctacccccagtggcctggaagcccagcttttcctgcatagcccttggttgaagacccatacctgagccttatgttcagcgaaaggccttatcatcacacagtgaggcttcctgctaaaatgcaatcgcctactgagatgggagccatggaggggattctggggttgctgttctctatcttttgagtaactgggggtcaaggtaagccaagccctggcctggtctgcagctgctgtctgcacactgcccagcctctccacccacttccaccatcacaaggagagctcttgagtaccctggagggtctgaggtagacatgatggtcctgtaggtggtgggcatttgggttgtcatccccatagctactaaccagctggccaggcctggcatggtatggaggctctgtctgaatgagccaaggatgctccgtctttagcagcaggacttttgagcagtgagaaggcactggggttccctggccagaggaggcaaatcaaatgcacgcagggctacactccccacctgcctcccagcaggtaccataagggtgagagtcggccaagtgtaagacaagtcacggtgtgaccaaccataatgcctgtctttttacattacttttgaaaacactatgcaggccaaaaccaaaaaaaaaaaaaatatatggccaaaccaaaagcatctgcaagccacattcagccttctggctgccagtttgtatcaaatgtgaaaagcaaaatttagttgtacatcactgagaattcttttggcctggtgaactctttcttggtcttccacatctagctccaatggcatctctgagccactttctctgaccctctccttaggccaaacaaatgcttctcctctctctgatcccttagtatctattgtaacatattagtatattcattcattcattcaataaacctctattgactactctggcaaaggtagtgctggggttacagagatgaacaaataagaaataacccctgccctcgagaagcaaccagcctgattggaggaaagatgggagggcagacagactgagagatccctgagggaggctccctctgtgtgtgtgtgtgtgtgtgtgtgtgtgtgtaaaagttgaggaaggtaggcttcgggtgaaaaggagatggctcagccaggtgctggaggaacaaaatgagtaaatcaagctgaagaggaggcagggccttactggcgcagggagcccctgagcagacccctggagttatggataccaatggcatgttcacgccccagtgtgttgccctatgtgactagtgtttaaggaatgaggacaaaataatctatacctcaaacccctgaggcatgcagtttacctgcatacctgcacatgtacccctgaacctaaaatcaaagtttaaaaaaaggaatgagatgctgtaagtggctgtggatcttggctttttgtcctctgaaggcaatggggagccacctgtgggtttggagctggggagtgatgagtctgatctcagctttgcaaggcccacactagagcctccacgtgttagacagtcaggaagtggggcgagactggtgatggggggccagccagggagctgtgtccccagtgcctggacctgcccactgcatacttgctgagtgagtgagtagatgaatgaggtaggaagggatgtggagagtggctgctgcccccacccctgtttggcaggggtggctttcataggcatccacttgggcatctcataggcatctcagacttgacctattcaaaccagacccctggccttgccccccaaacctgctgctcctgcagttttcaccatctcagttaatggcagtctcaactttccaattgctcaagacccaaacctcaaggtcatttttgactctcatactccacatccactccattagtagtttatgttgtttctacattccaaatatatccagaatcaaaccacttgttaccaccttcaagatctgttctcctgtcatctctcacctgggtaattatttgcagcagcctcctgacaggtctccctgcctattccagcttggatcctctatgctctactctcagcacaacagccggtgtgattcagcaaaaacataagtcaggtcatgtcctttctctgctcaaaaccctctactggatctctatttcagatgaaaagccaacgtccttacaatggcccacaggccctgcatactctatctgaccccctgacctgtaggacctcacctcctgctctcctgctactccttctgcactctgcaccagccacactggcctcctcactgatccccaaacagcctccaggggctttgcatttgctgttccctctgcctagaaatcttttcctctaggtacctgcgtggttcacttcctcacttcaggtctctctacaaatgtcaccttctcaatgaagctttcattgaccatcttattatagaataacacccccagccctgctggtcccctgagcccctccgttgtttcatttttctccaagccagttattgcattctaacttactacatattttactcatttgttttattcattgtctatctctccccacagaatgtaagcttaatgagaacagaaacttttgtctgttttcccctgtggtattcctagtgcctggaccagtgcctggcgcatgggagacactcagtaaggacttatgggatcaatgaataggtggactgtggggatcggtgaggttgtcctgggctatctcagggccatgtgatctgggattctcaggaacagatcacgtaggggaaggagagagccactggactgtaggagttagcaggtctagccagggtgaccttgggcaagtcccttcccctcactgtcctcaatttgtccatttataaagcaatttataatttgatgtgattgtctctaaggacaagcattatgagcctctgggggcaaggtgggggcctggccaactgggctgccattcatgccccctgggcatgagggcagagatcctcactcctgcagttccccatttcttttttgacttctttcaaagcgccatcttatcttcaccccacatctataaacataccatgtcacagctgttcaaatagtgatggggcggtggctgccagtcagcttcattcagccaggccagctgtgctccctgcagtatgcctcactctggcttgaaggcctgggcaaatccagcagtgggatagcatccaccccatttttcagagcaaacaattctatcacacctgccacacaggtaggcccatcgctggagcaacctcacctcctctcctagaccaaactctgtagaagagtctggtctggtttgggccaagtgtttatcaagcatttgttacattaaattttaatccttatgctaaccatgtgaagtaggcattattagactcattttcagaggagaacattgagtctcagaggggttaagagtgctgcccaaggtcccatgcaggacctcttcccccatgcaggagtctcttggaaatctgctgaccaaggtctaggaggctcacccatggttggagcaatgagacaggcagaaaggatgcttcgttcttccttcagctccatccaggccacaggtggagcctaagtggtggaaaacaggccagcccagatggaagtcatcactatcccactggttccctgagggctgagcaggagggaggcgccttcccgtcttgccctgccaggaatgtggggcgtcctgagaggctgggaccagtgagcaatgggggcggtgtgcgagttactccatgtgataaactattttcctttctcattccaaggatcagagagcacttggtgagctgttctttgttccaatggaaacagaatatcagaaaagcccagtgggggacagtcaaagtttcctttgtcttcttgggctaggaggctgaatgggaggactgtggcaaggtgggtggggcagggccactacaagggcaacaaatcggtagaagggggatcaggacaggactctacgacaacaatgggggaagaaaaacccacaaagagctaagaacgtgccagtggggaggccttacagcctccctcgtgcagccttactctatgtggatctgctaagtctgacagtctccagcaaggggctggggagtcacagcacagctagtgctctcctggcccaagatgtgccaaaggccacctccaggaccactgccctccacacgtcctctgaactccctggcccagtctctttactgcccccataacacaatgtgcttctaccaagaatgataggaattcaaatttatcgaagtctttgaaagtttgccaagcactttcccatagctctccaggaggcagaatagcctactggttaggaacacaggctcagggcccatactgcctggctctgccattccactgctgtgcgatcttgggtaagttacttagcctctgtgcctcaggttcctcatctttaaaatgggaataatcacaggatctacatcttaaggctgttttcagattaagttggctaatgtttaggctccctaaaagcagagatttttgtcttttattcattgccatgtccctagggcctaaacaatccctggcacctggcaggtactcaacagatatttattaaatatatataaagggcttaggatgggagctggcacttagcacaacaagtgttagtttttgttgttatcttttgcattctcacaatagttccaacaggagcattctgaatttcatgcatgttagtgttgctcctccttgtaaggttcaagttctaagtcaaggtactgaaggaatatgcaacagacttaaaatggagggcaaaagtttgggccacagaggattaggagtacagctgtcaaatattagtaaaagcattcgttcatccattcattcagtcatctattctacaaatatttcacaaatactcctaagggccaggccctgagctgagagctggggatgtattgaagacaagatagacaagggtttctacatttgaggagcttaacttgtaatggaaggagactagcaaaaacaagtaaagatctaaaaagcacttattagcacttattcagatagcaataagtgttatgaagaaaatcaagtagtataatgggatagagaatggctggggttgtgtatgtgttggggttgctttagtttatggtcagagaaggcatctgaggtaggaacactggcacttttctggggcgtcttggtctcaggtcaaggacctctgttgagagttggcctgtgacaccatatcatcaccacctcatccttctgcctaaggcaggggtaagctgctcagtgtagttctggggatctttacgtggaggtttagtgtgaagggctggagagaagggggctatgaacatgtggcgcctgcataggaaggttctggcattagttgtcctctggcaaaacctattggttgctctaggttaaacgatggtcagtggcctttcagctcccccttcatctttctgcactctcagggaggaggtgtctggccgtggggtcctctccactgctgatctatactcaatgccctcatgccccatgctcattcatgacaccaccttcacacatgcaaacactgcctcatctttcaagatagctcagacaccatcaccagtcacactggagggcccttattcattacctgtttgagcatctccagagcatagtatggaatggatacctaataggtgcttaataaatgaaggaataaatgagtgactgttgttccttctgcttcctcagctgactggctcattcccactcatgcatcaagactcagctcacacatcatcttacatgagaagcctccctcaacctccttgtgtctgacctggggagctcttgttcatccttgatgttccccttgacttcctcagccagaatttggccctcccacctctgaatgctccaccacattctattaccctctatcgtatccatcgctctacaggcactgtctgctactgtcctgtcacctcccctaatctctgattttctcaggcaaggactgtgttttggtcatctctatatccccagcactagcccctagagggcgctcaataaatatttgtgaaattaatggggaaaaaaccgtgaatgaattgtttgtcaattttgcttagagtggtgtgctggggctggcttgtagtggtttgcgagaatcaattgttaaatatttaggaaacgtatgagccagttgttaaatacagccatcattaaaaattaaattatatgagaaaacagaagacaaactgaaattgagagacattctacaaaataaatgaccaactaaatacaatatgggtcctggattggatcctagaatggaagaaagacttcagtagaaaagctggtgaactccaaataagtttgtactttagttaatgttgtactaagtttaatttctcagttttgatcaatgttttataattatgtaagatgtcaacataaggggaagctgggtaaagggtacacagaaactctctgtactgtttttacaactcttctataagtctaaaattatttcaacatttaaaaaaaaattgtcaagttccaatacttcttggttgtttcactttcttcttactcattaacataaatgaaaatatcaaccatcattcatttaggaactgcacttgctcttctgttatggccgaagtttggctattgatatgtgttcagcaaaaatcaatgaaagcattatgggagaatccattggttatatggaatttataataaagagtattatatatttcagtattatctgtaaattgagcacttcacattcttatataagtaaatttataataaacctatgtatgtatgtgtatatttatatatacgtttgtgcattttttttgagagctggttgctgaacacttaccagaacaccaccggtcctacatatgaattatgatctcatcaaacacattgaaggaaagaaaagaacattgcccagcaccttctctgtgcgaggctgtactatccctttgtgttcatcattacaggtgctctttacctcaactctatgaagtgagggtattgtggtctccattttacagataaggatattaaggctaagagaggttaaatgactagactaaggtcaagtattggtatacagtgagccagcattaaactacattcatctgagtccaaagccaattgtattagtatcatattgctgctgtaacacattaccgcaaattcagtggcttaaaacaacacaaatttattatcttacagttctggagggcagacgtctgagattggtctcactggactaaaatcaagatgctagcagggctgcattccttcttaggactctacgggacaatccttttccttgccttttccagcgtgtagtggctgcctgcattccttgacttcaaaaccaaaagtggccattcgagtctttctcacatcccatcaccctgattctgcttctatacatctccttctctgactctgactctccagcctcccgctttcactttataaaaaccctcatgattacattgagcccacccagatgagatgggcagcttctccccatttcagtcaatgtcagctgataagtaactttaactccacctgcaaaccttagttccccttgttatgtaactgaacacattcacaggttccagaggttaggatgtggacatcgttgtgggggctataatcctgtctatcacccttgtgctttttccatgaccttctcctgcctcacctgtcattttagtggtcacaaaatctgatgtggggcctatggaattcttcctgacacctgcattgccacacatctctgtgctctccctttggagtaagatgcccctttcagtcattcacccagccagtcagacagccttgtaggggaatggcttctaaatcctggggcttttaatcgtggacatatattttacctatgttcttactaaagtgttttaaaaaaatactttccaagatttttgtgcattcctggctttttacttcctttccacagtgcttatatggtgccagagccctcctttccaacatggctggtttcgctgtgctacggtttacccattcccaccttctggacctgtttctagtcagcagctaggatcatgcattatttatttgttcttctcatagacttttacattgccttcttctggaaatggccctggacttaactaaaatgtacttttcccacccctgccaatgaggtatatgtctgtctgtgtttactatttctctctgactggcttctcagaaacagactctctaagtaacagtttcccatcttcccttgtttcctccacactgagatccctaattcttgtcacgagaaacctcctccactgagaccaaccgaatggccagaagttgcccctccccccaggaagccttaacagccagacccatctcttcaccgcttgtgagctctgactacaacattcttgtctctaccttcagtcttgtcaacagctctttgctcctcctttctacctgtcagacttacacccatactttggggcccagtctgaatcctaccttaaggtaggctcaccttgaggaaaactttccagatcatcccagcccaagggactcatgtcctctgtatgtgtctaggacttattgtcagcagcacttattttgacaaatttatcatctaccattatggagaggttgcaaactgttggctggtgagccaaataataatgcccacaggtgtattttgtttagtctgcatgtggtttgtttctttttaaactatgtgctaacatgtagcaattagtaatctttccatacaatctggatttctagcttctttgaaaaacagaaaaatctggtaatactggatctgtatgcccccaagacagtagttagctagattggcatggccgggtggcagcttccactttagatggagtatgtgctctccagctagacacagtccccactactccgtattgtctcactccaacctcattcactcatttatagtaccttcctggctcctaaaggcatttgagttatctgacatatttcacacctgcctaagtttccagctatattacagtctcttagaggaaagaaactttattttgaatttattttgcttcttttatgctgctgtggacatagtagatgcttgatcaatattgagagaagaaataattttactctagataattctacagtgtgttagaatttacttttgctgcaagataaagctttataaatgtaacatctattaagagagtaccatgtacccgactcagtgtcagatgcctcggagcaactttgtgattagtgatattgttctcatatcacagataaggaaaccgaggctcagagagcctatccagtaggactggagctgtagatctggtagtctctgtggtaagaaccaaagcctttgttccatgaggaaaccttcctaagtatcaatgctggaagcagagaggagcttcccctgaggctctctggtaaagtttgtttacaaactcacaaactctgagacttaatttggtttggatagagattgagcatttattaaatgcttattgtgtgctgggtatttaccaaataactgcacttatttttggactatcaggaattctgagcatcctaggtagcccactgataagatgagggaaatacacataaatagaccctaattgctgatgggatttggaacccatttggtgagtcacattcaattgacagagtgcccactggttcccttgtccatatgcgcacagagattgtgctattccctcatgctgtcactggtggtactgacgtgtggtgcgggatgggaaaacatggagaaattatgcgtgtttaattgcacagcagcaagcagaaaggaatgtgagtgccaaagactcccactgaagcagaaatctggtgtcgtgtgttgctgaacagctgcaggaaaatttgtctggacctttggaggcagagaggtgggtttgccatactttggttctgagtaactttgagggcaacgaggatttataggcagcagatatgtacatctagaagtttcactctggagctttcacctggtttctttgctaccctatcccttccagccaccaccagttcaagccatggctaggagcagagggagataggaaggcctcagccccagggccactaggttactccaggtttcatgtgtccacagccctgcttagggccaccaaaatgctcaggttcagctgggtgggctaaaccacctagaactgggttcaactctctcctctattcctacaagtatggccttatgcaagtcacttaatctcttcaggcccaagtttacttctatgtgtgaggagtcagaaggtgatgttgcgtggggcctggcccatatcttaagagatggatctatgtccataacaccctgaatgctcccaatctcatcaagagatgggatctgtaagctctataatgattcagttgaacaataaactatcatagtcgttactctgtattgcgggcctgacagaccctatgctaagccattcatcatctctttaatccttaaaggaaagattaaaaaaatcttgagttaggagaggaagagtgactcatggaaggtcacccagctagtaaataacagaaccatcatgagctccaagcagagccactctagagccaacgcttctaaccacaccacctgcctggcattagttccacttcacacatgaggaaactgaggtttaggaggcattattatcaggggcaggacttgggtttgcaacttctgtctcttttgtttaacttgctgtgtcactttggacaagttgctcaacctctctgagctttggtttcctgatttggaaaatgtcagagtccaaagcctctggcagcagtgagaagcagtatcctgtgggagatggtggaggggaggggctaggaatgtcccggagacagagaatgagaagacatgggtgtgactgtggcattatgaagtggaggcagatctggaacggagacttgccagagtgaatgtgcctggctcgcactgcctatttagcagccgtcctgtgagagcccagatgggccaggtgggcaggaatctggccaggctccacaggcacacccacaccgtgagctgctgttgccacctaggggacaggcagtgaccaggggcccaagtttggctgtggctgtggctcagcggctgcacattcccagtctcctgctggtttccggagcggagagggatggccacggcttgctccaggagtggggaggggagtaaggaaaagcagtgaggagtgctgcctctggtttgggagttataaataaatccatctggaagtgtttggggctgtgggagcctgaggtcggccctgcaattcaggccatgtggtgcatatttccattcacaccagaaccacccccgcagccccctaccgccccgccccagtcccaggggactgtctgctaggacctgtccgctccggcccaggagagctgggcgagaacctttcaggccccagttttcagcccccacccccaccttccgctcctggcagcccaacttcagcaagataatgtctgagaaagtgcttcaaaaagttttatgtgctatccaagtgttggttgaatgaatgaatgaattttcaattcagcatttagcttgtaagctccccttgctgggaaggggccccttggtagttatggaaggcgaggcattctggacttttagcctccatctcaggatcacgtttcccacccaccgagctaaggcaggctgagatacaaatgcatattgcccaagttttgttcatctttctatcctcagcaccaagggtagcgctcagtaggcattggttatatgaatgaatgagtatctatattaatttttttaaacaacttttgtagagacagaggtctctctttgttgcccaggctggtcttcaactcctggcctcaaggggtcctcccgccttggtttcccaaagtgcaggcattacaggcatgagccactgcacctagtccaatttgttaatttaagcagcacttattgcacatcctcatgtgcagtgcactctgctgcatgctgagatcacagtggagaacaacatagagtccctgcctcattgagctagtggtcactgtgtttcttggtgaaagtactattgttgcttggggtgagtcaattctttgcagggtgggattctgtgcattgcaggatgtttaacctcatgattccctgactctaaaggccagtagttccccggagtcattttgaacaaccagagatgcctctagacatttccaaatacttccaggggacaggagagtgcagccctggttgagggccactgtggaggaacttgacaatggggcgtgaagcaaggcaacctccaaggtgtgaatgtgttgagtcctctgagttcacttataaattggtggtttagaactggggaatcacgtttgctttatagagatgtaagatgattcatcagtggctggattaggcccagaagcccataatgtagctgagttacatggttctaccagactgggttagtgctgaggggcaggcatcgagatggcaatttcggacatgttgatgagatgattacttgaaaatgtccagaaagtaactagaatctgatcccaggggcaagtgagaggtcagctctcaagatataaatttgggataagcccacgttgaggtaggagttagacctgaggcccaggttccattaaggttatccagggagaaggtgttgggaaagttgcagaatgactccaggataagtccagaggtagagaaagtaggccccagtggtatctcttctctgcctcctcatttctgttcccatggttagcaccctgtttcaggacttcaatttgtgacaggaccactgcagcaatctccttactggcctcctttctgcttttggtctctctgcctgtccgaattttctttttaaaacatggctttcatcatgtcccttcccaacattcaacaagtccaaactgcttagccttgcattctcacccactgcgatccagcttcccaccaacctgacacatctttggtgagttggctccgcgttcccctttccaggttcatggtttatccgtctctcagaccttactgtgtggctacacagaaccccaaatacacactgccttcctctcctccatgctatctccacccctgggatgctctttgaccctctttccatttggaaaaatctcactcaggcatcaaggcccagtgcaagtctcctgcatttccccaacccctcagaggcaggcagatgccttcccacctctgtgcaccctcctctccagctctcgctctgttgcccaggctggagtgcagtggtgccatcacggcttactgcagccttaacctgctgggctcaaatgagcctcctgcctcagcctcccgaggagctgggaccacagatgtgccaccatgcctggctaattaattttgtagagaaaggttcttgctctgttgcccaggctggtcttgaactcctgacctcaagagatcttctcaccttggcctctcaaagtgctgggattacaggtatgagccactgctcctagccatccagtttttcgtatacaccatgggactgcaagtctctcccacaagactctgagggcagtgaccatgactcgttttgctctgcaattccattgcccagcccagtgtgaatggacaagaaagtggggctgaggatgggctggtatggcagggcaaagaggaagtggaatggtctctttcaaacctcaccatggatctacttgagccacttttacctgctctctccctacaagtactgtctttggatgagggtttgtggaagagctaggaaagagaaggagccaaggcaagggacaggcagagggagcagcgtggagaagagaggagatgctgagaggatgaaagagaaagaaagtgggggagagcaaacgtctgcattggtggttcacatacataaaggattcaggtatggtagagtggaataagaaaacatttgggattctgaaaataaaatcagctgctttggcaggtcagctgaatgtacagttaattaataggcattagtgccctttggtgctaagctgtgcatggaaccatgtcctgctgggatcaaatggcagctacccggggatgcccttttaataaagagcagaaagcagcactgccatgtaagagctgcagaatccctcagagagttcttcttaagggcaccagggaccactggaaccccagagttgccccacatcactggcctggctcttgccaaagaaaggtgggcatgagaagagaactaacacatactgagcagctagtatcccaggggctatgccagacacacaaaagctcatttgatctttactgcaactctgtgaggtagcaattagccctgttttacagattagaaaatcaaggtcctaaggagggttaagaatcttgcccaagggcacaccgcttgaaagtcttggatcccagattccaatgaaggtcatcctctccccttgatgagcgggccaggacccagaggttggcagcagtttgctctccattctggctgactttggctgtggggctgatctctttggattgatttctttgaacataaacaaaataccatcagtttttcctggctttggaatgagccctcagaatcatgtgcttttctccagtttccagctgggtgcctttgctgggggagttcgtgaatatgaagcaacaggtctcattctgagaatcaacactgtgcaccaaaaaataccagggtacttttgctcccaggaggtatttcaagctggaggctttcagcctatggggccaagttttccattttttcttccctttcaatgacctgcatatgattgacagttgcctgttttcccaggaaaattataaaatctttatcaaaatattggcacctttgagttgttgcccacactctgttctgactgactgtgtgacccacgtccctatctgctcagtggttggacgtgttctgtctgctgtcaacctgtgagtcggtgagtagaggacaggaggtatggacaggacaggctgcggacagtgttttccaaaattctgatgtgacatgtttaagccaattcgtggaggagccaatggaggtagagtggctggagccaataaggggtttagagcaggggacaaaatggcacccagcaccaccccatggagatgcggctttggggtggggtaagttggctagaaaaccgatgatgatcgttttctggagttgttctggagtcaggaacagtctagaaaccctttgaattgaaccttggcacagagttgtatgtcccacacatgtgatagggtattaggattatcatgctgcatgcaagaccttctgaaatcttgctgcataacagaactttcagtcatacataatgacatgctgaggaataagttgctcgtcttgagtttggccttttgccctggtcattgtagtggaacaggatttttcttcaccaccttcaaaatcgattcagaatctggctacttcctgccacctccactgctatcaccctagtccatgccaccatcgtctctggcctggattattttagtatccctgtcaccagtctcccaaagtgatgctgtgaaaacatagtgtgagcatgtcagtatctgctcaacatcctccacttgctccccatctcactcagattcaaagtcaaaatctttatagtagtccacaaggtcctgcataatctggtcccccttacctccttgacatgatctcctacaaatcccatcgtctgcctctccattccagccacactagcctcctgatcattctttaagttttccaggtacattgtatttgcttttccttctgcctggaatgcttttccccagtatatcaggaaggatccctggagggagtgctcacaggaactgggaaacggttgctgtgtggagagaaccacctgacgggagctatggcctttggcagagggatgccgccaactcatggtgaccctgaacagagagagtggatgactaaataccccaatctcacttttcctttttcttctggtttctttgcaggtgcttcccattggtcaaacctaacccgaagccagagggcaagggagcctgttgatgccatccacacaggtcagcctaccagggtacaagctgtgtggagaagggtggaaaagatgtggacagacaaatggaaaatgtccagaacaactggatatctttgtagttggctccctcacttccttcacatctccactggaatgtttgttaccttttcagtatgtttcagtttgttaccttctcagtttgttaccttctctggccaccatttctaaaatttcaagccccagccctcaacacctcatatcctccatccatgctgtttgttcttcctagcacttaatactatctgacatgtactttatttatttcccttgcctatcgttggctctcccactagaatgagagctccatgagggcagggactttgttctgttcactgctatagtcagtgcctaggacaggacctggcacagagtaggtgtccaataaattgtgaatggataaatgattcacaatggataaatgatgtactctctggggccactctagtgagtctgctctcagccaggcacagctggatgtaggttaccagttgttactcattcctgctgttcacagtttcctctaaagaggctcaactgctgccatgttttcaggtcagcgggtggcaaggcctttgctgcctccggtattgaaacttgcacaacagtttgttgacttgaatcttatggaaattgttgctgcattaattggcatggactgagctttgtgtattatttaagttgtcatcagccacagtgggtagattcatagtcataggggcactggttcttccaggtggttcttccatacctcaaaggtagccttgattgctagtgggcctatttccaaattaggaggctcagtagccacttccttgaggctcacgggcaggggacctgtgaactgggtcctatgaccacagtgttggtgacacagggataggtgaaatcaggataagcaaaacagatatgcatttctagaacaatgtagttgtgtccaggctgatgtttttattatacaaataacataggaataatattcttgttgtgaaaaaaaatcaattcagctacaattcaaatctctatctctccggtcccactctgctccccgaaggtaaccactgttatcagtggagagtgcccactttcttccaaatctctttctgtgcatacacagtttggttttatgtgggtacttaaaaataaatggtgtcacaccatatatactaatctgctttttttcacttaggaatatgtcttggaaacctttctgttttaggagacatatggatctagttcattcttgttttcttaattaaacttttaattgtgattaaattatggattcacatgcagtataagaaataatacagagaggtcccatgtacccttcacccagttttcctcaataatcacttcttgcaaaactatagtacaatatacaagcagggtgttg

SEQ ID NO: 1102 - DNA, 99973 bp, mus musculus; identical to SEQ ID NO: 1101

SEQ ID NO: 1103 - DNA, 203142 bp, mus musculus; identical to SEQ ID NO: 180

SEQ ID NO: 1104 - DNA, 62962 bp, mus musculus
gtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 1105 - DNA, 62962 bp, mus musculus; identical to SEQ ID NO: 1104

SEQ ID NO: 1106 - DNA, 11567 bp, mus musculus
tatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataacatttttgtatttggtgcctgattttttttcatgttcaaataaatcaatctaaaattgaaatgcttacagaacttctgatgattaaaagaaactttgattctgtgaatgcggttgaagcagtctatttaagttatctactgatctttgtcaacagacaattagttattgacagtttctaattgcaaattgctttggaggctattttttgttagtggagaataatggggtcttttgcattttcttccaccaatatccaagcctgaatgccatgaacagagattgggatgactacacatgtgatgagcaggtaacctggtcagtctatcactcccaacccagacattccgatcttgaccttgacattgagggtgctggaccagattcctatttcaggctttttccttcacctcaaaccagagaccattttaaatgctcagcaagttctcagaaagtatatattcataagactggctctaagtgtgttccattgtgaaatctaaatagtgtatttttcttctgaactgtacaatgaacttccataatttaccactttctccatgagttccctcccccaccctcaatctaacctaactttacgtggaagtagagccatgggttggatacaggattcaaccaaaaacctgcctccctttcaattaaatgtattaaatatctcctgagacaaagagcagtttgatcttttcttagttacctgaaattattctaccataaaattttacaggaaagtacttgagggtcctaagaggggaagatatcaattaaatgaaaaacaattatgataaccaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcgccccatcgcctcccagcctcattaggccggcggggctgtaaagcaggaatcagcctctgcctaatccggacctggggtcaatacgagcccaaacaatggtgagctccgaaggccactgcgtagcgctggccgcaaactttgtgttcaattcaattttctaaagcggtgggggttgggggcagggaggcattcgtccacccgaaagccgcttgcggctcccggggctcatcagcgaacgtcctctctcgctcggcccctccagccttttcgcagcgcctgggatagagggggcggcgaggcctggggactggttgtcggcccgcgcgggtgcccaggggctggcgcaaaaggggccgcccccgtgccgggaacagactttgaagtgggtttttagcgcgcacgtgtgagagccgggccagggccggagcggggacccgctgggaggaaagaggaggctccggccggggccccaacccctcccccgcttccccgtggctccggccttttcaagccgcggccgggggcccgtaggcctcccacacccacccccactcccgcgccctgcccgcgccgcgcgcaggcgcacacttcgcagccgtcgagtcggattttgcagcgagggggttggggatagagttgaaagccgctttgcagtgccgcggcctcggtcgagctgggagggaggggaggggaggtatgtgggaaggggggctggttttggggcggctctcgagtcgtgaacatggcggccggatgcgaacccccgcggagcgcagcaaagcgcagcaaaggctgcagaactgttgcgtagtttaaactcccttgttattcctcagttctgggcgcctcgcgggggaatgtaggtcgtggcggttgagcgcaaaattgttaaaaaaacggaagcgaagaagttcttcctgggcattctcctgggaagttggcgtgtgctttttgggtttggggttcccatgggacttggacaaaaaacccgccagaggcctccccacccacctggcccgacctaaaacgccccctccgggagctgccatggctaggggatgccatttcgagttatcaggccccggtcgggattccacagaaccttgagtccctaaaaatgccccaagagcggacagtatgttctcttccaggacagtggcgaagcctatgaacacgtaagcaccattttccaagaaaatgccccggctgttagacaaatgtgccattgcgagttcgacccctacacgttgcccaggctccgttttctgtatatctcatttaaacgtgagcctatgaaaattggcactgtagctttggtgtgtgccttaacagctggtgatcttatgttaaggggaaaaaaggccagaattccgaaaactttaattcagcttttgcttaactgccttaatgctggcgttgaaagaacccctggtagctctgggatctcgagctcgtgttttgtccgtagaaaaatgcttcggattcaccttcagatgtgtcttttgtgaggaaaaaaaaaatgtaagattttaaaaagtgtagtaattgaacctcagctcctctaggaaaataagcggcacgaactcttccaggttgggtcttcgtggagaccaacggccaaacggaaaagtcagccctcttggggttgtccagtgtcacgcatttgggctcctgaaggtgtggggcagttcccgtgggccaccttgggaagggccccaggtgggtgggcaggtcattagcaaggctggcccagatctggggggaaatctgcaaaacagtgcctttatctgcagagaacaattgatggggttgtctttcctccttttcagtgcacaaagaagacggctttggagcaagaatttggaatatgcatttaagttgtcgtgctttgcattggaaacccatgggcaattaaaataagcatgccctgtagtattttctgtccttttcttatgtgtgattcctgcaagtcaaaggaggccggagcctcttcagtagtttggaaacttgttttgaaattgccaccaagccgatttttttttttttttctgtgggtgaagtttccttccccggttcactcactcccccattccccaccccctcgctggaatagagtattgacatctttgagagatcaaaggaagtaaatggtgcttgctgtatactctatttttccattctgtagtgtgaaccctgaggtttgagcttttttctggttaaatctcttggtaccaaaagtgtggaaaataaaaagttcattaagttaaaaaagctttagccaatggttagacgggtttgtccctttaagagctacagagcccagatcgtctcttaaattgactttaaagtcgagctaagatgcattggtggactgtttcccctggatacctgcggtgttctttgggtcatttgacatggtaaaactggttgatttttatagaagttatgtgaatggaatttctgcaaaaccgggcaagtgataaattggtagagctcttgtatttgtttggatgacgactccaaagggtactgcttttttaccgaggtttgattctgtcataaccattgaaatttacagcttggaaaacactaagtttgctggaagcatttaaaccagggaatgttcagagcacttggactaatggtaacttttaacagacgaacataaatcctttgaatattagagaaacttgtttcaaaaaatctgttgaaactgaagaaaatctctttcattaacatttaacaaaccaagcagttttgtatatttttaatctgatgacagttcaacctatttacacatctgatgaatggagagaaatgtaagctttatagtaactataataatagctttcaccagatggcaaattataatatttgatctctaatagggtgtgtgtcttgtgtcatatattttattaaaatacaacctgcgtcaagaccatttgaatttgaggtgttaaaaataaaacattccatcgtgttttattataaaccagagtttaaaacaacatattcatgtgacattttatgacattcttttctaagaggaaatgtggcctgttttgacctatctgcagttcactttttgtttttttgccagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaattat

SEQ ID NO: 1107 - DNA, 11567 bp, mus musculus; identical to SEQ ID NO: 1106

SEQ ID NO: 1108 - DNA, 11567 bp, mus musculus; identical to SEQ ID NO: 1106

SEQ ID NO: 1109 - DNA, 105708 bp, mus musculus
tggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcagatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatcggtaatttttggagaaagaaagccagattttgaatagttcccctttcatattttaggaaatgtgcagaaaattctgattataaattaagtggaaactatttttactcatttttggatggagagtggaaaatgaatcattcccaactgtgtggttcgttatgttgtctgaaacatcttggactttggggaggtgagagaggtactggttgtgtgtgtgttgcgggggtggaggggtcactttggtttggtgccaagtgtaaaagaatattaattctccatgttaagcagagagaaagtctgacttttagtgtcacatatactcacttctttgggttaattttaaattggaaaatcatttaggattacccccttagtctgcttgattcttccccaaggagaaagggagaaagttggctggcaggagctatgggagagtctgcctgagtatattcccctggccctggccctgagagaagcacaggagtcctgtaggagatatatactataccctatcattcttccccatactatcattcttcccctgtatctaggaggttggctttttagccagtatctgataacagggtttatttttactttttggttctggaacttcactgttgacatttgtaactactttttatatacgaacctccctgattaggattagtggcttctaatatttatttgttcaataaagaataaataaaccattatgttatagatgaaaagtcagaataaccagaaactagcctgtctttttaacatgttctcaaagtggattagagggcttggggtacttagtttagtttcatgatcttatttagttgtccagtctaccaatagggttgagacgcaggacacatgtctttcagcaggctaccagtagttcaattaattattcaattttaaataatatttttattcacgacagttattagagcagtaagtcctatcagagtaattattttctccatcacctctcacttttcactcactagtcccaatatatatcttagttcatgatatatggggcatttctataaaacggcttcatattttagaattttcattatcacatgagtttccatccttataaaagattgttgttatcgttttaataaattttggcttcataaaagaggccaaatttcggtgactgtctattgctgatagacttcaactcaatattataagtcccatacaacttttttcttgtgctgcccatgtattttcccctctactcctctaaaacatgctaccttcatctaccccagtgagcctcctgtctgcaaaatataccattctcttttctgattcttaactgtcactagtgttcttctcttggcctgtttacaaatcctacgtattctttaatgcataattcaaaccccataagaccactccaaaacatcacagctacgtcataatctccttcaggtcagaaataatgtcttgtatttctttagtattctccttagtttctagtacacatagtattttctcaagaaatccaaatgaattcagtcttcataatggatttgcaggaaatataccagtgcctatagcttgctttggatctcatctaagaagatataaatctgtcttgccattatatataccctgaaagtctgaaaaaagatctcctgtgaactactgacaatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagggtgggttaccataggtgagggaaaagaaaaatgttgtttctcactctcagtcaggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgccatgacagaggtttgcacaggatgctctgaagcacagtggaggggtcagggaaaggatatcattgagttcaaaaacagggaatcatgagtgaatttattggagaagaaggaccaaaccggagagagtccatgcggaaagaattgacaaaacttggtgaatgactatgatgattatacaccatgaagagaatgaattaaaaaggacttttgaggtggagatgtcttgaaggatggtggtattgaggaggacaaaaatgaaattaggaaggggtggcagttttttggggatgctttgactttagatttgagtctgatgtgattgtgggtcatttaacaatcattcattcatcaaacatttcttgaacatctattaggtggcaagcacccggataggtattagggttacagtgattaagaaagcacagcctcaaccctgatggagctctcaggttagtgtggggaggcagataattaaggacacagttatgagatggtgtggtaagtgcaatgacagtggaagaacaggggctgttacagaacataggaggaatagcaagatagaatttgggtgagtttttgaatgccctgttaggggacaggagttgaggcagggaaggggagtgctctagtcaggagaaaagagtttgttgaaacatctggaggacagagagcatgggggtttctcagaactgaaagggcaagtgtcctagaaagggttaaaatttaggctttaccagtggctgaaagattgggtctggagaaatagacttgggagtcctcagcgtggtggtagagccatgcagtagtgagctgagcaaaggccaaggattgagccttgcagaacactcgtggtctagaaattaggcatgaaggaatagaagttgaaagagaaagagggggatgtgtatgagaggcaggaagtgaagaggaatagtgcaagtggaatacaaccctgagtcctccaggaaagtagagttggctttggctcactagtctgagggttatcaaaataaacactagatttaagtttttagtacaggtttacttttagaatgtccaaataataatgtatccatttgagctagagatgtaatcatgctatgcacctgaagatgggggaaagaaaagaatatgggaaggtttgggcagcatttctgataaggagagtgggggaggtgtgggtctcagctggatgatcacagagccttttgaaaagatggcaagtctttcacctggcttgagggtcaggttattctttaacaaacctgaagtagagtagacctatatgatatacatccagtgtatcaccttcatctcattctgggacgtagcctgtgtctatacaacagcaaataaatgtttggggaaagaataaattctggcataagggtgtgggcttcagtttgtgaaccagatggcatgttctgttgttgagaggccatatgtaattgatacataaagtgacagactgaagcaaaagcaaagtaagtattttaagacaagcagttaaaaaaagaaagcagactgtgaccctaaaagcatgtgaagattctggcttctggcttttggaagagctgaaaatgtcggtgcatagacaggatgtcaaaaaagagcatgtcaaagaatagtaatggggccactggctcagattatttttaaagatgaagttgtcttctgtcaatcaggaagactcaggtttgggatgaattggcctttctgccctatttcacttctccccttcctatgctcaccccaaggttcaattcccacataaaagcagtcaggatcttgtctaggtttagataatattccccttgtaccttttagacagcaagagagaatacagacattctatgacagtgccatgtttcagtggaaatgatatgtttcaatagaactaatacagattacacccccttttaggcttcagtacttactgtgtcaggttgatgtgtgtaggagtgctcatatatgtgcgaatacatatgccttcatggagtatgacaaatggagatcatggtccagtttgtgccataatggggtaatctacctcgctttaataaagaggtggtgtcttgatgtacgcctagttttcttgagagagtcaatgagaaagttacctgaaataatctgtgtctagagaagtgaaaaaaaaaaaccagcaattatttgagggttgaagaagccatttctgttaatgggatgctgtctggaagaagaatagcctgtgcccagctttctcagatggcaaaacattttcctctttgggaagggaataagagagcacaaagaggcctaatctatacaacacaataaaacttgggtaaaaatggaatcagtgtagactgccaatttagctaactgaggccttttaaaatctgttatgcaaatcagccaaatctttcccttactttgtgctgtttagacacatgtacaattttgtgtgagctagcataatgtagtcatctggaggtgaagaaggtatcacagtttcataaactaaaatggcttctgtaacatccataaaagggaagcacacaaagacccagaggtaacctcttgcagcaggaaatgggagcttcatcctgccccctggctgccaacctcctgtcctgtttcctaccagcagatatctccattccaatctcccctgccactttggctctcttgctgtcacggtttaactgtcctgagaaagttgcactaaccgggcttgaacataaggaacctggcccagtcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgctaggcatgataaggaagagtgacttccttagattgcataatcgcttcaattctctgtttccctttgcatatgttcattattgagaataaattccaatttgagaggaggctttaattccttgtaaatgaataggaaatgagtaagtaaatgttcggtgttttcctcaaattatgtctcatattgtaagaaaacagtggcaaaaagccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaatatgccatatattttatttctttatactttttatttatttatttatttatttatttatttatttatttatttattatttttttgagacagagtttcactctttttgcccaggctggagtgcaatagtacgatctcggctcactgcaacctccgcctctgcggttcaagtgattttcctgcctcagcctcccgagtagctgagattacatgtgtctaccgccatgcctggctaattttatatttttagtagagaagaggtttcaccatgttggccaggctggtcttgaactcctgacctcaggtgatccacccacctcggtctcccaaagtgctgggattacaggtatgagccacccactgctcatggtcttatttctttgtacttttctcattacattccttgtgcccggaacatcctgcccccatgcatctctgtctattaaaattctgtttatccttcaaggcccatcttaattttacttcctctttatctgtgaagtcactgtaccttgaacagagtaggtgttcaatacatttttgtattaaatttctgaactgccactttttttattcctctgacatcaatttagcttagagatcacgtccaaatcaatgattgcttcctgtattcttcttccttccccttttctttgccaagaagaccacagattgagatggtagtgggattaaaggaggccaggggagacattgtgccccaatacaagaaaaatagaataaatggtgaaaaatcacttccatgggaataaagccaaggaagccaagagagacctggcaggaagggtagcaagggttcagctggtcctcataatccagtttgagaaaatgtgaaatcacactacccagcctgcaaacacgtgtatctatgtgaatatatccatctattcatgggaacagtgccaaagatattaaggagctacaggtacttagcagacagaaaggggccaagtacacaaatctcttcttttccttcatgttccctctctcccccacatccccccatccactttttcaaaagcacgaactttgaactacaaaacataggaacaatggagatagcagcgtagcacttaacatgactgagggaaggactgctagcagaatgagggccagtaagttggggtattacatttggaacagactttatggggtattgggatagtgggtgagagagaagtagatattggggtgagtcttagaggaaaagcagctaccagggctgaaagacttgggagtggggagaaataaaaaagcccatgattaatctagagtgaaatgatactctttttcacataacgaatgggaaacagtagcttgctcaactgaaaacatgctagaattccggctactgttgtaacaacattatattcaacagatctgcaaagtacccctaatatgtacctgaaagaatctatgtaccagtaaatgatgatatgcaatggatatcttctctttttaaaatatttatttattgagatagggtctcactctgtcacccaggctggagtgcagtggtgtgatcctggctcactgcaacctctgcctcctggggtcaagtgatcctcccacctcagcctcctgagtcactggaactataggtgcatgccaccacgcccaactaaattttgcattttttgttgagatgtggttttgttgtgctgcccaagctggtcttgaactcctgggctcaagcgatctgcccacctcagcctcccaaagtgctgggattacaggcgtgaaccaccgtgcctggctgatgtcctctcttgatacagtcaggctttgcattttgaagccctgcctctcttgtgggtgaagcctcggtgccaaagaaggaaagctgtgagatacaatgctagattttgatgaattccacactcaaaatactctttttttcctgaaggaccctactgataaatataaaatattataatcaaaaacaaaaaaagtcatggaatactgcagcaaaactgtgactgagggctggatacatgggttccagtcctagttttgcacatgctagtaatatgactgtgcaaaatactttaactccactttgaagcttggtactcccatttgtaaaatactagcatcttctactttgtgagattgttatggtttttaaatagtatatatgaaattgcctggcatagtgtctggcaatcattcaataattacagatggtccctgacttaccatagttcaacttacgatttttcaatttgacagtggtgtgaaagtaatatgcgttcagtatgcttcttgacttatgttagggttacatctggataagtccatcataagttgaaaatttcttaagttgaaaatgctctctctggaacataacttcatcataagttgagggacatgtgtaatagttttcttagtctactcatctggaaaagagataataatatctgttcttcatatgctgtgggattactatgagggcgaaatgagatattgcctatgaaatactttgaaaagttaaagatattatctaaaacataaggtttctttaatgtcaataaattcctacatccacaaagtcatgaatgtcatattttccccaatagtgagcaaatgtgcagcattattaatttgtacgtagattagtgcttggctcatggcagatgctaaatgaatctttgaaacatttgtctactgactaaccgattttcacatgacattggttctcaagctcatggttcttttttcccctcttctcggttcccctctggattcataccctctgcgatgacagcaaactctggagatgaacctcaccaacctggttaagcgcaacagcgaactagaaaatcaaatggccaaactaatacagatctgccagcaggttgaggtatgtaacagaaacatttgtgatttttcagaggacctgaaatgggtgaccctttgggaggacttcagttttgtcagagtgtagcctagtcatttggaatgaaggattgaatggcagttttagaaagtctcattcctttaggatgcttgttccaaaaaaagtgtcagaaacctatggtttaaaaagaatagacggtgatgatggacagtggggggataatagttcaaggggcaacctattctcctttccaaacagcaggcaatatgaaaatcagacatgaagtgtgcttcatccatcatcaaactggacattatcactccttaaagagattactggagtgtcatagggaagttgggaatcctgggtccttggggtaaggtgaggttaattcagcacaatattgtttctgtaacaatattatcaggactgcttctcctctttcgagcctctccccctcttcatcccctgcccatggtcctatctataccatgcaccccacctggtcctcactcattacctttccacttattcttgtcatcaacaaatcatatctattttaaagttgtaaattgtaaagtgctgtaaagtgtgaggttttaatcaattgtcatctacatcaaatcttagagcagagcttagaggaagagctgacctcttcttaaatggacataataaaataaagatgttatttctctttctcaagagcatgaaacttataccatttggttttgtgttgattttgttgaagagctgatggtagggcttcaagtgtaaacagggttgggtaaaatattataggattcttcatgggcagtggttggataaaaatgtttctaattctatttagaacctgatagtctggttctaatcttacttgtatgacagacaaatgtaacagttcaagtttattttatttcaattttattaagatctcatctcttaatccaatctatagattcctatttaagagactgtggagaatcttcttgtaaggcaaagaatcctcttattatatgagtaaccttctgacccccaatcatttggatttcttaaagtattgagtttcttcaagtagagtgtacttgtatgatgagcataccatagaaatttaatccctgctgggcactccatttgtggaagagagtggtgctctacgtagggtccatagagtactggtcaaactcagatatgagactataaaatgaagtgggggattagggaagaagcataaggaatgaaaagaaagagcactagagtgtgatttggaaaactgtgctctagacttggctcttccatgaagtggtggtatgaatctaagtcatttagcttctcagtttcagtgttcttacctataaaatgaagagttgaactgataacatgaccttcgacttctttctaggtatcacaggtcatgatgctgtgaatggtaactttctttattctattctttttctctcctggcttattctttccaagaagggagaaacaaaatataaagtatttcaaagtggctttcagctaatcagaatccctctaatgttccactctgtcaaagtttctcattatgctgttagattacagtataagacatccacactggcaaagggacaagggagtattgtaagcaggagacaagataagagatcccttgatttagaatttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttgcccaggctggtcttgaactcctgagctcaggcaatccacccgccttggcctcccaaagtgctaggattacaggcgtgagccaccgggcccggccaacttcctcttaataataacaacggtgaatccaggttacttattatcctcattcaacacagagcctgtctctccaaaagccttcaggacaaacctcaggattagaaatctagttaatggagggacttgagacttcataaatgcttaaaaatacagtagaaaatgaaatgtatagtagaatactgtcagtcatgaaagtaagacactgatgggtgatttggaattttttcattatatgtaatccagattcatctatagggaatgactatattcacagtgtataccaggcatttcacattcggcgggggcggaggataccagctaaggcgcttctgagaaaactggaatagggtattttcctgtcaaacctgttccccttctttattgtctgtaaatgtttttgtcacaaattgccttttcataaaagggccataaatactgcctccctatcatggttctttctccctgttctctattctcctcagaaagtaaacaaagctgcagtcttcctattataacagaaacagagattaagatcactacagatttgttagctgacttctatggtaatgtagcttgttataattgctgctgaaggtttcagaattcagtagatgggtggttggaaaatgttttctgctgcggctggagagcatgggaaggaggtagaggcagctccaagactccctttaatctaattaaggaagggcatgctttgaccttgctatgataaccacttgatctctatatatagttctttgtcctggctcatcaggcatcctttgtttacatttccaaaggaaacctctgtataatgcatagccaagggaaaatgtataccaacagatgaatacttcctcttcgcttccaatactccatggttctgtgaataataggcattctaaaacatagcgaggggcaaatatagttaaatacttagtaatcagttggtcaacagcatttattgagcatacgctgtgtactctgtggtgggcgatttgggggctacaaaagaaatatatgtggttgatgacctccaggaactttcagtctagttagggaaaacagtatatagtgagaaagagtatttatagagcagcatgcagtgcagaaaatacaaatgaatgtagtatagccctttcaattttacttatttagtcttgttcttagcttttagggcactgagtaaattaaaacactttcctgtatattttgtgtgccacctttttcttctttccagaactgctgtgatacaatggcttaatccatcccagaagctccatgggcaggttgatttccttctggctcttctcaatccttttaaagagctggacggcactgctctttagcattaggagaaagaagaaagaaaggagatgagttggaagagagggagaggtttcccttagtctggggaatttcagctttctgtcttgctactaggtcttagcttcattcacttttggaagtctctctctttagagttcaaacttcagatgggctggtattttcttctttctgctcgtattgcccattggaaggatatttagtttgggaagggcaagaatcttggagtctatgtaatagatgtctggctgcttctccaagcataaaatataaatattttaaaataaattaatttaaaaaacactgctatggatgatttcagcagatgatccttaaatatttttgggtggttgagctagaagaaagaatagaatttaaaccattagagcacaaatacatttgttggtggagccctctttaaggagcagtcagtgaaattagtataattggaaaatttaatggagaaaatgcattttagccaaatgttgaaggagaaaaaaaattactccctctggagagacagaaagcagaggtattagtggaggtgtaaatgagcacattttatggggaaaatggtgccttaagcactgggtgtatacagataaataggaaatggcacctgccctcaaggaacacacagactggctgagaacctgacaggtaaaatggcaaatagaatgtgaagtgataattactgtaatgaatgtaaatgcgtgatgacaagttagcatggaggaggaaacactcaggcctgcctgagaaacttaggaaaggctgcagaatggaaaaaaaatgagttatcttgaaataagagtagaattttgccaataaaaatgagataagggagtgaaggggaccacatgtgagaacacagaagggtgatcagcatggagacgttcagggaactatcagaagtttggcttggccagaatgtaagacatgagattgcaagaggtgagtatggagaagtgagtagcttgggcccaaataataaagagccttgtaggccatgtataggtgtttagactttaacctgagaagtctggggagccatggaaggattttaagcaggtgaataactgaataaaatctgtatttaagaaggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaattatagatggagaaaattgtttccatgaaaaatggaaaataagttcagtgatccagtcaatctattcatttatactactgtagtgactaattcagagtattacattcaatcttattaagaatataacgattgacatttaatatagatgaaaaacctaagttaactgtgcaatccagtgtgtggtcatagcctatttttatactagaaaagaaagtgctttataatttttcagagacctaatgcattcaatcctttttaaaaaatactttgtgacaattcttcatttatgtcagtaaagtaacatttttgaagacattaaatgttgcagttgaaatacttggagggtattaacacatgacagggtttaaggataaaattagttaggattaatattgttttcctcgccctcctccctcacatctatagggcaggtaagctttcaggtgtggtcatgtcttcatagccgaaacagttcacataggaatgcactttcatcccacttttgcacttttcctttggcacagtgaagcttatcttacagtcccgtttcccatccctcctctagttctcatttctgtgttcaaattccaggtcactcactaaatgaccagaagacttgcttaattttggctcctcttgtttgctccactattttcacaatccacccaaattccccatttccagtgtgctcttggaaagttaatggaatcttaataattcagctaaggctctatcaagcttatcctataccttgaaatgtttctagttccacttttacctctaatctctcctgccatcaacccaactaaaactaaacaaatgttttaaaaacccagacttgaaaccaaaacaactatcaccacagcagataggcacacagccattgagatgtccttactgtctctgcctgtctagaggagtccagctctgtggtacggtaagcaaggattgggaggaagagaatcttacttgaataatttgttctgggcactgtgctagagacatcatttctaatctcacttagtgtttatgacaatcctgtgatacagctggttaatattcccatttttcaagtgaggaacttgaaggccagagatattagatgccttactcaaggtcacacataagtaagctgggatgcagttctacatttctctcactccaaagtctatgttctttccattgcattgtgcagcctagtggagaagttgttggtttacttgccaccgattcatttgtgctcagataggtaggaggcagctccagaaaaccctttgtttttctccactaaatagctctagctctagaaaaacatatggtctgtttgggggcctggcgttcctgaatctgtggtaagcctcttatgtactcctgccattggcctacctttaatagcccagagcagctctccatattctgacagcccttcatggggtacagaggagagggagttgcctagagttggcagaaggaagcaataatacccacaattaggcatttacttgctcagattatttttgtgccatgaggggtggaaatagtgtgggcagctccaggtatcaacactgtcctcagccatagagtttacgctgggacccatattttcttgctgagactgccgggatgggtcctcattctagggctgtacatgaccatgtttcagggtaaaagtagtctccatgagacacagggtttcttaacagttactaagagtttgacagtaaagatgtactctcaaaagtataattaatgtttgcacatttaaaacaggatataaataacaaatataataccacaatgactgcaaatatatagatttcctcaaaaaagagtgaatgcattgctattattaatggtgtcttttgatggaatgattacttagaagtacacatacagccaggaaatcagctatttactacctcaagacagaaagagaatccaatgcctctgtctattctcactacctctcctctcacctaaatcaaatcttgaatccaagtttaccctatctcagccagtcctaagaactcttaattattcctaagagctttaaatacattagctcatttaatccacacaataacccaatgaagtacatatgattctcattctcattttacagatggggtaactgaagcacacaggggtaacttatttgtataaaatcacaggtggcaaattaagagtttgcatccaattttactgaggtccttgctcttaatgactatgctgtattaaaaaagatgggcaaaactaacaacccatggctccatgtgcagtgttttgcaagtcgctgattattgtgcttatggtctgggtaaggacagaaaaccagaaaaccagtattatgtgagcgtgtgcccatgtgggaatgatgtggtgtgatactagagcaatatttgggcaagcctttctttgtgatgataatctctccagagcatgcatcataatgcctctgcacgtgctatgcatctgtctatctatttcatagatggctgtgcctggctgttcatctcttatgtgtgtctggggagggggttgtatgtgtaaagaggatatatgtggaaaaaaggatatatgcccagtgagagaattagtgtttaaactgggtcatgaggattgctttgacctgtttccctccccgcccaccccaaagggttcttttcagtcctttgatgttttccccatataaggggagaaactgggacacaactggaggatgttgccttttgttttctttaatgagaaacattgactctttccttgagagaaggttttcctcctcttctccatatcccaagcctgttccagcttctccttagtaacatcaaaggcacaaaacaatcactggctttggaataatttctaaaccaataaaactctagctaaaagtgtatagcaccagtgctagtcgcatagaacaacatagttccatcctgagctccctcatcccaatctatatatgggtagttttgcactggcatagaatggcaggtttacgaatgtccaaagatgtcttattagaaaaatctcaggtacaggggaaagcccaggacacgaggaggattagagaagagggtgagtgacctaggcagggaaggataacaatgctatgtgaaaaggaaggagaaacaattacacgatgccagtttactctatagtgcacatataatgaaactcctgccaaatttgtggtgtgttctagcatctgaagagctttgaatcttctagcaccctggggatattctgggattccaattgccacccactcaacagtcaagaaattcaaaccatttcaggaggattccattggctttagaatgaaatggaatttatattatattggtagctcacagagaacacttacatttaagaagtaaaaatatatcacagatgaatacgcaaattgcatattgtctgcaggccagagagcaaaattaaacaccttcatgctttcgtactccatttctgtcaaaaacaggatatcagcagcaaagccactgaaaacacacacacacacacacacacacacacacacacacacacacacacacacacacaacactgacctacagtgagtactgccaaaccccatgctaacccagtgacacatcattagctcagaagttgaaagcaaatggtgttcctaagtggacctttataaaaaatattaagctccactgtgggtttagcatagtgttatgtgatacagaggaatatagtagcaggtgtattaagtctctatccctgtcttcaaggactttatagtctagttgagaaagcagagctaacagtatgaagcattgccaagcaatataaaataatttaaactgtgtgacaataactgtaagtgctgtagtagttcgggggagagggagatggaagaaggctaacatcattaccatcattaacatctattgtttattaacacttaatgtgctccaggtgtcatgccaagtgctttacatgtattatctcatttaatcttctcagttacctctgagacaggcactattattatccccatttttcagatgaggaaactcagatagctaaatgatttatccaaggggagtgtagaaatgagactagagaggcatggagggacctgattacagaggacattaaaagccatgctaagaagtttggcatttattctaaggtcaaagggaagccaattgaaatttagtatgaagccattttaagcacgggtgtagtgttttttgttttttgtttttgttttgttttgttttgagacggagtctccctttgtctccaggctggagttcagtggtgagatctcggctcactgcaacctccacctcccaggttcaagagattctcctgcctcagcctcccaagtagctgggattacaggcatgtgccgccacgcccagctaatttttttttttttttttgtatttttagtagagacggggtttcaccttgttggccaggatggtctcgatctcctgaccttgtgatccgcccacctcggcctcccaaagtgctggagttacaggcatgagccaccgcgcccggcctgtagtgtgttttttaaaaagtttatactgcccctctgctgggttaagtacacattgggaaaataaatgattggagacagaggggccaattaggagactgtagtagcattgtgcttggcacatagtaggcactcaatgtatatttgttggatggatatatgaattcagggaagagattttggtggacagatctagtgaaatataagggaagatgatagaaaaggatagatttgaattatatttatgaggtaaatataggggatgtgatgattaactggatgtggggaataagaaagagaagttaagaatgaagccctgggtttctgaggagctggtgatacccttcattcatttagggaacattagagaagaatcagatttaatggaacaggatgtaggaaagagacgagttcagtttggaaacactgagtttgtagtgcctgtagttatgcaaatgaaatgtccagtaagcagttagttatataggtctaaatttcaggagagagacttaggatagacataaatataattaaggcaaatggagatctttttgaggtgatggaattgttctaaaattggattgtggtaatggttacaaaattctgtaaatttactaaaattattgagttacccacttaaaatgggtgaattttgtggcatatacattatatatcaataaagctcttaaaattaaaaaagttaagcaaggtactggcatgtagagagtaactgaagccttagaaatggatgaggtcacctaagtcagtgtgctagaactctcagaatgctgacatttaagggacagacaaaggagttggaatgatcagcaggaaaactaggaaaatttgtctcatggaagctgaaagaagaaagtattttcagaagaagtgaatagatgatcttttaaataatgatttgaaagacttaaatatcttgaaatgtcaatgggaaggagtggaaccagaagagaggttggctgaaggaaagggaagaagattaatcaaatgaggaccccaagaagctagaagaggatggaatgcaaagcctctaggagaggactgatgaactttctagagagatatatcacttctttgtaataggagaaaggaaagatgattgtttccttattgttttgtgagaatttaaaataattccctgggataaattttattttctctgtgacaaaggaagtaaaatcatttactacgattttactatgagtgagaagggaggtagtagggttgaagctttgtggatggtagagatcgctgctgtggagatatagagagagctgttaagagaaacacagaattaataagaaactttgagagcctgcttgaagttggacaccacaaatttaagggggatcaatctatgcttccatgattagcatataggtcacacttaaaaccatgaaaatgaatgaatttggccaggaaaagttgattaggtgaggaaaaggacatagatatagattagatagagataatatatattattaactttttacctgtcacgtgttgtgatattttccccccagtttgtcttttgtctttattttctgtatggcttctggtttttctggcttgtgaaaggtctccccctcctcaaactttcttttcatattttcggtggttttattttttatattttaagtctttaatgtacctggaatttgttttagaatatgagattttgaaatgtattttagggcatgtagttgtgtttcctttcagatagataactattatgctaagcccatttattaaaagaacagtccttttcctgttgagtggatatgctaccattgccatatattggatttccatatgtacttgcttctattctagactctattctgttccattgatttaattttccattcttacgccaataccttactattttgattatactgactttttggtaatatctgatatttccttactattcttagatatttgtttctccatatttttacatatttgtgtctccatatgaacttttaaataattttgtatagttacaaaatatactcagtttggattgtgattatcactatattacagttgtgtattagtttttagaagaaagacattcctatgatatgtcttcctatccagaatcacggtatatctttgcattttttcaggttttatttttgggaccgtctctttaatatttagttgttttcttcaaataggtacagtacatttttttgttgttgttgattcctaagtactttgtactcttgtccgtgctgtgaatgggttacttttctatttccatttttaaaagcatatggagaaaagcttttgattttatatattttcttgtgtattacaatcttaccatattggcaaccttatatttaaaaaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctccttctatttactttcatttttttgtccttttccagtttcttaaattgagtgaattcctgtattttccatttttatatattttcctgagtagaggtttaactgtatcccgtatattttggtatttagtgtgtgctctttcattattttctataaaattaacaactttagtttcattttcctctttgattacaaggttatttaggagtattcaagcagaaaatttccctgacccctttgctggcaggaactggagtgcacgggtgctagaactagtcagccacttcagtgccagcaggggcagactccacttgcttggccccaccgtgttccacgccttgcaggagggggagcgcaggtgagcaggtgaaggagctggggcaagcgcttttgggtgctggcaggagcgaaactgtgcttccccacagcagcatctaggggggtgtccatatctcctgaagctccagaaagagtgttacagtcagtgctcttttagctttgctgtccatgaatggcttaagtgttaacagctcagtggagggtcagtgtgacggccttttgcacttgcacttgagttcttgttcaacatccaagaggaatgaggtcgcatgaacaaattggagatggtcaatgtgggggattttattgccaatgaaagtggctctcagcaggaaggggagctggaaaggggacagagcaggatgatcattttcccccagagtctagctgtccccagctggactcctcttcgaagcaacaccgtaaagccgtccctctgaagtcaagctgcttctttccaacttccaaccatagtccccaatgtccagctgcttctcctcttctctctgctggtgaaccctggggtttttatgggcacaggatggggagcagggtggggtatgggtggttttggaaaaggcagctttcaagcgggaaaataggaatgcgtgttctcactttgggacacggttccaggcttgagggcaagacctttgccagagacctatcctcttctgcccagaatttccctgcctcctgcccctgtcatttccctcctctgaagaggctcatctaactgctggtgtaatatggacgatgactggtcttagctacttcctgtttacagggggtgtgagtatgggaagaacagcagtcagattcctccccaaggtctacctaagggtccccagcaaaagggagccattgtctgaggttctggttgcctgactgtttggagtttgatggcctctaggtgcaaagaaacaagttttacagggttaagtatgcatggaccaaatatatgtccaaagaggagttaaaaggagagaatctaatgctgaagattacagaaataagaagtgaaatatactaatcattctgaaatcaacattataccccatggtatagcacagaatggaggtaaaaacaacaagcctaggcaagactataaagaggatatccatggaaggttaattattaacacttatcttttgtgatttttagcttgagttccccaatctcttcacataggtactttgggtgctcttctgggttgatgcaggtaactctgtcagcttcccaggcctttactcgggtatagtgaatacaatgatctattccagtgactttcagtgccataagagtagaaagaagtataatccctcccaatctgggcttatagagggagaaagggaagcaagtacctttaccagtattaggtccactgggttgaatagaggtggccctagttcctgggattggacctccaacagttgtttcagttcctgttggaaatgggccaaagaagttatatgtttaatcaaatcagaggatttttggtctagcaagaaatcattcgtgagaaaaggccatccatacatcatttcaaaggaactcaaacccagctttggaggggtgtttctaacatgtagtagggctatggggagaagggtagttcaggggcgacgagtctcctaagacagcttcctgaggtgcattttgataatattcatcttttctacctttcctgaggattgtggtctccaagcacaatgaagatggtactgtatgcctagtgcctttgagaccccctgggtgacggctgccttgaacaggggccattatcactctggaggtacttagggagtccaaagcaaggaattatctcattaattagtacttttatcacctcagagactttctccgtctgacaaggaattgcttctacttagttagtgaaggtatctatccacactaggagatactggatgcctcttgcctttggcatatgggtgaaatccactgctagtcttcccctggatagcctcctgtcctttggattcctgggggaagaagctgtcgattaaggggattattttaaaggcaggtctagcaagcattaacgatctgtttaactgtatcaggtttttacctgagagcaatttctgggccaactgatgggttttatccttacgtaggtggaaagcttggtgaaggattttaagaactttccattggtcagcagcctgtagatgaagcttgctgtcctccaattgtagccatcctggggactgaaagatgtatccctgagagattgcccattctatttccacaggagaatatttagattatatttctcttaaggggccctctcagatcagtgaggcttcaagtggatcagaaatctgaggctttgttgctgctgatttagctgcttggtctgccaatctattttgcttggctacttcatccatacctttttggtggcctttacaatgtattactgccacttcacatgtgagaaaaaccgaggataatagtctattaatttcctgatggtatttaatgggactcccattacctgtgaggaagtttctcgctttccagatagtggcatgggcacagaggactaggaaagcatacttagaatcagtgcaaatgttaactgtttttcctttgcttaatttgagtgcccttgtgagggcaattagtttggctaattaagcacttgtccctgagtagagagacacactctcaacaatatcattcagagtaactattgcataccttgccttatgtatcccttgttctacaaaagaacttctgtctgtaaagagaatccagtttgggttctctaagagggtttccttgagatcctctctggtcacataggtctgtactactagctgttcacagtcatgttcaagcttcccagcttcctctgggaggaaggtggctggatttagggagggacaggttcttaattggacttcagatccctctaatagcagaacttgatacacgaggaggcagttgtctgttagccagagattccccttagaagacagcagtcctgacacattatgtggagtgcaaacagttaagttattccccatggttaacttagtagcctttggtaccagcaaggctactgctgcatctgcctggaggcaggctgtccatcttttggctaccaaatcaagctccttacttaggtagcctacaggctgctgggctggaccagggcttgtgttagcactcccagggccatttgctttgcttctgacacataaagattaaacatcttccctatggggagactaagggctggtgccttaagcaaggtttgctttagttggtcagaggcttttctagtcccaggttcccaaattagagagtgagttttagctgcctgagtatcctttattaggtgatataagggacaaactatttcaccatacccaagtatccatagtctgaagaatcctgtaatacctaagaatcccctcagttgcttgagggttttggggaggggaaaggaggagatggacttaatcctttctttgcccagtgctctggtcccctctgacaagatcagaccaaggtacttcactgaagtctgacagagctgagctttagattttgaaaccttatatcctctattagccagaaaattgagaagagccttactaccctccgagaggtttcctcagttcgagcacagaggagaatgtcatctatatattgtaaaactttaacctgaggataaaggaactcagagaagtctcttgacaatgcctgcccaaacaagtgagggctgtctcagaatccctgaggtaacactgtccaggttaactgggtagtttggttagagggatcctcaaatgcaaacaaatactgggagtcagagtgtaatggtatgcagaagaaggcatcctttaggtccaggactgtgaactgtttagttccttcaggtacttgagatagcagggtatacagattggaaaccactgggtgtaatggaaccacagcttcattaacaaggtggaggtcctgaactagtcttcattccccattgggtttttgtactcccaatatcggagtattacaagggctgttgcagggtttgaggaggccctgcaaccttgttatcaatgatggcttctagtcctttcctaacttctggtttcaggggatattgtttctgattaggaaatgaggtgggatccttaaggtgaacctggactggtatggcatttgtggattggccaattttcccttgaattgcccaaacttctgtgttaatatcagtcttcactagggggagacaaatagtttgttcagaggccaccagaatggtggtccccatactggccagaatataccggttcagcagaggagttgggctctcaggtataattagaaaggcatgggtgaacaacaagtctccccagctacaactaaagagttggaaaaaataccggattaagagcctttctgagatacccctctcatttgtgctaagagaagagaaggggcccggattggagaggagagctgagagaccaaccccagtgtccaaaaggaggtccactttcctccctttgattttcagaactacctggggctcctggatggtaatggtggtctggaccactggagctacagagaggagccctgggacccatcagtcctgctgaaccatttgggagattggctctggacctggtgaccagcctccctggggacagtctgccttccagtggtccccactacagattggacagggtcaaggtggcttcctcatgctgccttggcaatcctttctaaaatgtcctggcatactatatctgtagcagttaacaggtgcacctcaggaatcctggggtttgtgggctttcatggtggccattaaaccctctgcttctttcctatgttttctctctctctcctggacctccctatctctattataaaagatcaaggtggccactttcaggagattcactaaagtactatctggtcccagggtctgtttctgcagtttcctcctaatatcaggggctacctgagtaataaatttatcctttaggattagttgtcccttgactgaattgggagatagagaggtgtgctttaccaaggcccctcttagcctctccagaaaggcagtaggattctcatcaaatccctggtctgtcacgggtagcttcgtataactgagaggcttagttctggtcctacgtaagccctccatcatggacacctaaagtgtctcctcttccactctcccatctcaatattgggatcctatttagggtcatccaatggtactgcttcccttccaattggataaagtttgactccttccctgacaatatatgtgatactaagctcatccccaaatccctctgtcagctgcagaatggcgtgcttctcagtgttagggtttgattcaaaagtaacataatgtctttccaggagagttcagatacttgggttatattctggaaagcctctatacaactgtcagggtcatctgaaaacttgccgtgatcccccttaatctgccttaagtcctgtagagagaagggcacctggaccttactggggtcaaattcaccaggcatctgttggagaggcaggagtgagactggggcttgtccagggtgaagatttctaggagggggcaagtgagagagagaagctggatggggaggaaggggtggacccagaggagcagcgctggagggagctggctgtcctgctggaggtgtctctggggttcatttctttagttccttgggattgccacttgcagccttccctgagatggcaaaccggagggctgaaccaatcctacactatcagcaaaggtctggattacttgcaaggaaaagaaagtctgcatgtatggcctcagaccatctgtcctcatgtttacagaaaaggtccaactacacgatggtattgaaatgaatggttccttcctgaggccaagacagtccttcctgcagatcacaatttggctaaacctttgtgctatgaggcattttacctccagagtatgagggtcaaagcagttccagtgattcaggataccctccagaggagtacagactggggtggtgaagatagctggttacccattccgaaagacagggaaataggtgtctctcatttcacttccttctttcagtgaaaacttgaggtatgagggagagagaaagtgaacctcctccttttctcttccatcattttatccccaagacttggcaaccttagatggatgccacccacaggtgccattgcagcctgcactcataaaacaaggagggcctagagaataggaattgtctgcactcacctatgccttcatcccctttactgccggcaacctttgggttcccagggctttatctatgccgtggagcatggcctccttccatgaagcagaggcttaatcagcaggaatttgtcctacccatttatactgtgcctgttgcctcacttgggattcttcagatctggttttcctttctagggcttcaacccaaagtttaaaattgagtttagggcaaaaaggtgcatcagtgggtgcatggattcatttagattaagtccatgatgggtcctgtcaaacttgcagttatcagccagcggggccactcctccattgctgccctatcataaccagagtgccgaggtaggaaaagaaccctatcacatagaaaaagaaaggaaaaaaaaaaaacagctgaagagagggggaagaaccccttgctctatgcaaatgggttcctttaatcactgtattcttcccccgctttggactgagctgaactcctcagccagaggagtaaaggctctatgggcgtgtgatgggaggggacggtgagtgggaaatgctggacagctgcccgtgtggggtccctgggccccaagactgccctggggccctggctgcagctgtgattttctcctgccctccatggctgttggaagtggcacatgcatgctttggacatgcccaagtgccccagccaggaggggaggggatggagaggaaactcactgcgtgccatgcatgtctgcagctgttggggtgggggtggggatggcacctctaagaacaaacggaaatcacattgttctgaattgcatatctgattgctgggccaaatgttcattctacttaataacatttctgcagtttgcagcaaaactcttaacattataaaagaagcaataggagccatttcaaaccatagaagaagaaaggaaagataccacagaaaaatctgagcatcttggcggaccacctattacattggggatggggtccagttcaggggccttctggcaacaacgaggagtggcattggccagatgccttcagctgccccaggactttattctggtcccacatgatggctagacccatgtgaagggaagcagagccttttacccaaaagagaaatggcagggttgcatcctgccccctgcaagtggcatagatcagaggaaagtctgaggacaagaaaagacagatccacatttttgcatttactcacccttctgacgtatcccagacaaggccctaaaatggagcaggaaatttccctgacccctttgcaggcaggaactcgagtgcaggggtgctagaactagctggctgcttcagtgctggcagggatggactccacttgcttggtcccactgccttccacccatcacaggacggggagtgcaggtgagcaggtgcaggaaccagggcgagtgcttttgggtgctggcaggagcaaaacttcatgtggatctgcagcagcatctggcgggggtggggccatgacccctgaagccccagaaagagtgttacaatcagtgctctttcagctttgccatccacatatggcttaagtgttaacagctcagtggagggtcacggtgactgccttttgcacccacacccgagttcttgtccagtgtccaggaggaatgaggtcacatgaacaaattggagatggtaaacttgggggattttattgccaatgaaagtggctctcagcgggaaggggagctgaaaaggggacggagcaggaagatagtcttcccctgtagtccagccatccccgaccagactcctctccaaagcaatgctgtcaagctgtccttctgaagtcaagctgactctctccaacattcaaccatagtctctgatgtccagctgcttctcctcttctcttctctctgctggcggagcctaggttttttatgggcacagggtggtgggcagggtgggccatgggtggttttggaaaaggcagcattcaagagggaaaacaggaatggatgttctcactttgggccacagttccaggcttgagggtgggacgcttgccggggacccactctcttctgcccagaatttccctgcctcctatccctatcagtatgtttcttaattttcaagtggttaaggatttgggaatttatctttttgttattttattcttattttacaggatagtgatcagagatggtaaactataaactttttcttcatgatcaattttaaatgctccatgaatataagggaagaatgtattattctgtatgatgcaaagtttacatgtaactattatattgatgtattgatggtttttttctatagtcttatttttgtttaaaacttgttttgttagtttcacactaaaactataactgtccagtgggttcctcttgtctgctgcccagatagagctgacttatcaagcagaagaattggcaatacagagaatttaattgacatgaggtgggccatgcctctcagaatttggggactagggtttttctttctttttcttttttcttttctttttttgagacagggtctggctctgtcacccaggctggagtgcagtgacatgatctcaactcactgcaaccttgacctccctgcaacctcagactcccgagtagctgggactacagacacatgctgccatgcctggctaatttttaaatattttgtagagacaggatttcaccatgttgccaaggctggtctcgaattcctaggctcaagcgatctgcccacttcagcctcccaaagtgctgagattactagaatgagtcactgtgcctagcttagggttttccaaaggtagtttgggggaaggggtgggagtggttagtcattgccattgggaagtggttctcttgcatgctgagtcgcttctgggtcggagcacatgagtgattggcaggtacaggtggagccattcatggtcagatctacaaaaaaacctgaaaaggtatctcaaaaggccaatcttaggttctacaatagtgatgttatctgcaggagtaactggggaaattgcatattttgtgaactctggaataatggcaggtaatcatttatgtctacatcttagcagaattcaggcttttctatgctttgagcctggtggtctctcattagctttacaaagatggtcgagttttggggaagggttcttatcatttaaactataaactaagcgtctcctaaaattagcttggcctaagcccaggaataattaagggcagcttgaaggccaaaggctagatccaatttccatcactgacatcgttttctcactgttataagttttgcaaaggcgatttcaaaattgtatcttttttctatcttatccctttctatttttaaggatatttatttcctagaagtggaattgacagtttaaagtaaagccacgtttcaatgtattgacacatattgtcaacagtctctatttgccaaggcaatttatactcccaccagaaatgtacaagggggcagattttcctttaccatgctgttagagtgctactaaattcagtcacctacacttagcctttttggtcatctctcagagaaagattgttggatgctgggcagtagtagagagcaggagctcccactgggttagggttaggtctgacaaaattggtgaaggtcatccagtgggcatagtacccctgttacaaataagactgttgaacttttgaggtttgggttgcttcaatacagaaagaggtcacagaaatcagaagcagttttgattaagcagttaaatgtccccatgttcgacttaagtagttccctccacactttctgccatccctgcatcctctagatttctcactctctttgttctgcccagtgatgaccttttcttctctctggtgtgtccttcaaaacttgttttctgagatactgaaattcacaatgacatatgaatgaacagaaaccactgtacagggatctgccttttcataaaggacatacgttcctgaaagtagaattttaagcatggatggggtgtatagtaccaatgaggtcttctatttcttcactaggaaacagcactcattaattattcattagaaatatacatggtatttgaaaaaccagtattaaattcctcttcataaaatacctgattcaaacaaatcaactgtaaaagtacacttttttatgtaatcaggacaatttaagtatagaacaagcattagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagaggtaccagaccagcgtagcaacttggagttggagaggagtaggcatggaaatcaatatttatttaattcctactatgttccaggtagtgtgctaagacctttgtctctgttatctcatttgattctcataaccacttgtgaggtaggtaacattgtttctattttaccagtcagaaagatagctcagagatgttaagtgacttgtcatgaagtcacttggctttcaagcgtcaaagcaggaatgcagattcaggccagcctggcttacaatccagactttttcccactctactctgctgcctgagtagaaatggaaacttagcacaggaaaatcctcaaaaaaagggaaaggtggttttcctcaaaaataaaaataaaaataaattttagctacaaagagaccaaaaacaaaacaaaacaaaacaaaaacagggcagattagaatggaacatggcagaagtcttggccttggagttaggatgcccagtttggttgtaactctgtcatttgctagcttatatgactttgataatttactttacctctctagatctcagtttcctcatccataaaatgcagacagtagtgtctaccctatctaatcaggttgttgtgaagatcaaatatagagatcaaatatatctgaaagcactttctaggccaagccataacaactacacagctgtaataactatacaaccataactaattatttcttttactagcagtaacaatgtattaagatggccagatttttggaatttcccagcaggttgagatcccttcccgtttttgtttttgttttttttccaggagaatctcttatttatttatttatttatttatttattttattatacttttaagttttagggtacatgtgcacaacgtgcaggtttgttacatatgtatacatgtgctgtgttggtgtgctgcacccattaactcgtcatttacattaggtatatctcctaatgctatccctctcccctccccccaccccacaacaggccccggtgtgtgatgtttcccttcctgtgtccatgtgttctcactgttcagttcccacctatgagtgagaacatgcggtgtttggttttttgtctttgcgatagtttgctgagaatgatggtttccagcttcatccatgtccctaaaaaggacatgaactcatcattttttatggctacatagtattccgtggtgtatatgtgccacatttttttgatccagtctattattgttggacatttgggttagttccaagtctttgctattgtgaatagtgccacaataaacatacgtgtgctcgtgtctttatagcagcatgttttgtaatcctttgggtatatacccagtaatgggatggctgggacaaatggtatttctagttctagatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcccagctgctttgtttacctactcaagcctcggcaatggtgggtgcccctcccccagccttgctgccaccttgcagtttgatctcagagtgctgtgctagcaattagcgaggctctgtgggattaggtccctctgagccaggcgcaggatataatctggtgtgccgtttgctaagaccattggaaaagcacagtgttagggtgggagtgacccagttttccaggtgctgtctctcacccgtttctttgactaggaaagggaattccctgaccccttgagcttcctgggtgaggcgatgcctcaccctgcttcggctcacgctcggtgcgctgcacccactgtcctgcaccctctttctgagactccccagtgagatgaacccagtacctcagttggaaatgcagaaatcacccgtcttctgcgtcacacacgctgggagctgtagactggagctgttcctattcggccatcttggctccatcctcctgtttgttttatacctttttttttttttttttttgagaaagagtctcaccttgtcacccaggctggaatgcagtggcgcaatctcagctcattgcaacctccgcctctcaggttcaagtgattctcctgcctcagactcccgagtagctgagattacaggcatgcgccaccatgcctggctattttttgtatttttaataaagatagggtttcaccatgttggtcaggctgagcctaaaacagacctcaagtgatctgcccgccttagcctcccaaagtgctgggattacaggtgtgaaccactgcgcccagcccatcctaatcagggcctctgacccccttggggttttccccgtagaaacccctttgtttatttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctatcctttttttttttatacccagcacatggcttggtacacgaataggtaccgagaaaggatatttggataaacattgccatctggtggccagatgttgtaagtacaatcttttatgcatcataagggtgagtaaagcccaggtgagtaaagcacctaggaaaggcaactttttatttattttaacacagggaaaggaaatatttcagaatatgtggtctcctagaatctcctaggtctcctagaggtgttgttattccaacgtctctccaaatctttcataattcagaaaacaatatttaaatgacacaacagataaaactattttgagtgtgcaaaaataaaatgaaagagaaatttgtctcatgtaataaagaaatgtaacatagtatacaataccttttttcataatacctttatttcaatgcctacacacattcattcattcaacaaatatttactgagcatttactgtgtgacaagcactattctaggtgttagggatacagtgaacaaaaagtgcttaaacttaaggagcttacattctaatgggaggagacacacaataaacaaacatatttttattagggattataagtattacggataaaaataaactaggttacagagtggggtgagtgtgtgtgtgtgtgtgtgtgtgtgtgtgtgtgtgtgaaagagagagagagagagagaacgccagttgagcaaaggcctgaagatatattagaacttcagaaaactacagaaatgttggttgaccaggcctgcctaaaacattatgggacttctagagagttttctttcttttttctttttaaaaataagtttaatcttacataaaagttgctaaaataatacagagagttcccacatacatttaactaaccttctctaatgttaacatcttacataaccacacaactatcagaactaggaaactgtcattggtacaataattctattgagcaaactatagacctcatttgatttttaccagcttttgcatgcactcaactttttttggggggggggtggatagttctattaatcttatcacatttatagattcttgtaatcaccactgtaattaggacattattgttttatcatccccccaaaactcatttgtgctacttctttataggcacatctgtcccccagcaaccactgatatgttcatcattactataattttctcatttctagaatgttatgtaaatggaatcatatagtatgtaaaatactgtgatttgctatgtcactcatcataatggccctgagagccactgaatttgttgtgtacatcaatagttttttattttttattactaagtagtattctactatgtgaatattctacaatttgtttatatgtgcccacggtgaagagcatttcagttgtttccagttttttgctaatagaaacaaagctgttatgaccattcgtgtaaggtttttgtgtggacataaatgttcatatttctagggtaaatacacaaggatgagagctagagagttttatttcttcagagggatttataagcaagtgccatgctttacaaaacaagcagtagattggaaagaacactggataggactcagaagatctggctcaagccttgccctgtcatttagtagcaatgtgatgctggataagcctctcccctctctaggccccatatttctgtctcttaagtgatggagtaggaatcgattatttcttcagtctttttaagatctaattacatggttctgacgagatagaaaggaggtttctgcctcatttcacaaaaaattttatagctatgtacataaaataccagatgaaaaacataggttatatctcccacctttttcttccatgttccaaacagttacttggtggcttacacctgtaatcctagcactttaggaggccgaaggtggatggatcgcttgaggtcaggtgttcgagaccagcctggccaacatgatgaaacccatctctactaaaaatacaaaaattagccgggaatggtggcgcatgcctatagtcccagctactcggcggggttgggggggtttgggggctgaggctggagaatcacttgaacttgggaggtggaggttgaattgagccgagatcatgccactgcactccagcctggacaacagagcaagactccgtctaaaaaaataaaaaataaacagttactttgcttacaaagagaatatgggggagacagtaactaagcctaaggctataaaggtttggttgtctgttccctgaggagaaaggactccaaaatcaacacagaatggccacatggcataatgccattcctaaggcatgtatatgaagcagattgtcctcacgctctgtctccattatttttattagttagacatagagtaaagtacatacaaaatatatgtgtgtatatatatgtgtgtgaactgtctatgcttttaaaatatgttgtattatgcatttctatacaggtactattttttttcaaaagtcaggaaggaaatacacaaaatatttgcaatggttaactctagagattgtgattgtcgtgagaggcaactctaaaggaaaaagaagtatatgtttgtgagcacagcctctctctctctcacacacacacacacacacgcacgcatacacacagtggttaaaaccatagacatgagccagactgcctgggtgcaaatcctggctctgatatttactagttatatgaccttgggcaagttacataacctctatgttttctcggtttcttctatagaatgggaatggtaataatagtacctaccttatggggttaatgggaaaagtaaacaagtgaaaatacatgaagcaattagaatagtgcctaacatgtggttagcactataaaagtattaactcttatgtactcctcccacaagcagatagaaaacttttctgtcagtcattgtctatctgaaggcctcacgtagcatgagtccctgagcccaattcactacgatagttatacttctagaaatggcttggctgccacctccccatccacactacttttctaactttaacagccaatctcccagctacctctactctcctaatccctcaccccttccctggccaaaaaaattacacactgaagctgtagattccttaactatgtctcagtattttttttgcttgctaaactgtagttactccagtacaggtgactaaaaattctattaataatttcatttatttcttgctcctttaagtgaccaccctccctcaaatctaaagaaacaggtataaccaattttttttaaatccctgcttcatttagtcatacttacgtaaagctggaaggaccatctttgaaatgttgcagtgtttacctttagaaaacaaaaaagaagattgtctcttcttcctcttccttttgtacatttgaaacttcctgatataacagggctatagtgctggtggtgatcatgatgctagtgctagtggtagtgatgtgtgtgtatgtgtgtgcgtgtgagagagtgtgagggtgggaggagagagggagaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatctttgcaacttatggctttggcgaactcccacctatttatttcctagtattgaacagtggtaaagtccttccatcaggggccttatgtgtttgtattaagaataggtggaaattggggaagactaggtcttactctacagtcagtctttgggctgggaggtaatagggtaggatgggcagttggaaagaaatatgcaagtcaaatttttgctgccttaagaagaaagtaaaagagcaaagagcagagaagaggacctggagacttaccagggagcctgtgttgcctagtgtttaggacttggaagattgaggctaagactcttagtcataaacatcacaaactgcctcccaaaagtctttttggggtgggtggatttatacaagtaggttgccaagattgacctaatggtattttcaaggaggatagattttttttccacagacataaagccatttagacaaaaccactaacctaatacaaagagcgaatgtcaaataaagagctagggtcttccacaaaccaaccaaccagccaagtatgcttattaaggtaacccagttattttcaattaagcgttaataagcaagtgaaatacctcaatgtattatgtcttcaaacaaagaaaataccaggggctttcaaatgtcttccaagcaatttgagttgttttattcacatcacaaagaccggttttccctgaagtatttcctgttcagaaaacacttaaggaccctgctcttctggggtgcttcttgacatgaaaagattttaatgtcattgctttacctttagtttggaattgtgcctcttcagccaacttttcattctattagttgtgcctggttttatctcccctgatgtgactgtccaaaaaacattcccaccctagctccctcatttcaccttatattttctctacaaaatacactcactggagtatattttataatgcttggcattcttattttgatttttttactgtgctaaatcagtcagtaaatgtttgttgtaaggctttgtaccagttataatgggagagacaaagtagtgtaaaatcttccctcaaggagcttgctgtctaattgaagatatgtaagcaaaagagtgcttcttatatttgatatttcctttctattactgatattctccttgggtatgccctgtccacatcacaacagcctcctaaatagtcctcaggtttactattaccctccatcaaatcagtccctgttcatcttcttaaacaagttcactgtggtacttctcgcaccaccttacctttcctcccctcaaaaatactacttaaagataccatattgcctaaaaataaagttcagtctcatttgtttggcttgaaatttctctccttcacacctttttaatctaagtcttattccatctttaagatttaattcaacttccatttcatccatgcatctttccttcacttacccaccaaaagtaatctttccttttaatttcagtagattatagtctacatcacccattcagtatttaatttatgctaccttgattggtttcttttatatgtatatggctcttccccatccagtttgcaaagtttttgagggcagggccttagcataatgctttgcacagaaaagatgcttgataagatgtctggtaatgaagacatgatttttcctggcttcagagtagaggaaggattatgaggatgggtggcaaaggaaatattctggaggtagggagattaattaacgaggtttttgcaacaacagtcctatcacaataggtgataagggcttcaacctattggttccttggctcagatcctcactatattaacgaataagggtagtcaagtgaagcagtgggaatggagaaggaacaaagaaacctgtaactatttgcgatcagttggttgtaaacactactgcacttggaccagccactgaggaaatttagcatgattaaaaaggaaaggagggaaggactttgggactgctgtgaatttatgtggggacaaaggagaagtagcagtcagagtttactgaacctgagtaactgcaataatgatagtagcattgacacaaaaataggaaaatcagaggtggaagccagatctggagagaaggtgataagtttgtttttagacttactgagtttagggtaacttgagtaacaaagtggacatgtctaatgaggagtaaaagataccttttttcacatttaattcaatccaacaaataattacggagcatctactatgtgcccatcatgatagtggagctagatatagtcacataagacacaattcttgccctccagaactcatgatggagtgaggaagacagactaatatgataaaatataggaaatggtataattgaactatatatagagtatgtgaaaatataaataggggatcaattgcttgtgtccaagcaagtgagaaaaatcatagaagtgatgatctttgagaagggccttaaaagataagtagaaatgtgttcagtaaacagatggggaaatgactttccaagtaaaatgacaatctcgggcaaaggcacaggacatgaaagtgcatggcattctaggggaacaacaaggagtctgaagtgactaatgagaaacggatgacagaataaagatggatgatttgaaagagatgatgattttcagaaattgaagaaaagggtgttgttacactcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtggtgcttcaatgcccttgcatcattaatatcatcatctctacccttcttctaggagtggatcttatgagggaggtatggaagaagttgtgcatgcttagctgtcagtccgaaccttttagagccagcaggggacaaaggcaacaatcactgtgtaatactctgaaatttcttggcaggtgaatactgctatgcatgaggcaaaacttatggaagaatgtgacgagttggtagagatcatccagcagaggaagcaaatgatcgctgtcaaaatcaaagagacaaaggtaaagcgcagcacttcagtgaatccaaggaagggttgactttacaaatatcaaagtttgatccagatgattctggtttgatcatgaaatcaagaagaaatgagattatagggggagaggcaaagaagtgatgtttggcctactgctctgaatccagtaaaaacgatggccattctggggtgttagaaacgttctatatcttgacctggtttacgtgggtgtatgtgtaggcaaaagttcattgagctgtacacttaggatttgggtgctttactgttgtatgttataactcaatgaaaaggaaaaaagtaatggtagaaatgtgagtcaggattatggaccatgaattccaggatgaggactctgggcttaatctgaaaagtgttgggcagccattctcgtttcttaggaagggagaaagacggattgatatggcagaggtatgcagggtagatcagaatgggatgataccaaagtcagggtagcaagttatgagacttatggaatgatgctttgtaagagttgataaagacctaaaccagagtagtggcagcacaaatgggagggaagaacacaacaggcactgctagaaaggaaacgataggaaacattgaacttttaaatataaaagacgaatgagagagagggaagactcagtgaagacattcaggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattatcaatagagttcttactttgtactgggcattattttaagccttcataagtattaactcacttaatcctcaaaaaaactttatgaggtagatactacttttatccccattttataaatgagagaacgatgttcagagaggttaaataacttgcttacaattgtccaactagtaaggggcacaggcaagattcaaatttagggagtctagtgccacagtctacacttttacaacaaagccaagcaatttcagctctatcagatgtttttattggcatgaccttacatttctaaataacatccttacattggtagttttaatttttttcaactttagacagtatcaattaacttctgcaaatttggactttttttctgccactacttctacaaatatttttatgccacttccttcctctctattcgggattccaattacatgtatatttggctgtctgaaattgtcctatagcttaccaatgctctatttttgttttgcagtctttttatttttttgccattgtgaaaacacatgcaagtgtgtttcattttggatagcttctattgatatatcttcaagttcactagccttttcttctgtgatacctaatctgctgttaacccctccagtgtattttttatcttagatattataactttcatctctagtttgatttgggtcttttaaaaaatgtcttccatatctcaagatattcaggctgggtgtggtggctcacacctttaatcacagcactctgggaggctgaggtgggaagatcacttgagaccagcctgggcaacatagcgagattccatctaaaaaaaaaaaaaaaaaagcctgcatctggtgacatgtgcctgtagtcctagctacttgggaggctgaagcaagaggatcttctgagcccaggagttcaagggtacagtgggtcacgatgctgccactgcactccagcctgggcaacaggacaatgtcttgtctctgaaaacaaaaaaagatatttagcctttcctctagctttctgaacatatggaatacagttaaaataattgcttttatgtccttgcttgctaattctaatacctgtgtcatatctgggtccgtttcaattggttgccttttcttctcattatggattgtattttcttgattttttgcctatcaggtaattttttactggatatcagacttgttaattttctctttcgggatgctgtatatttttgtattcctataaatattcttaaactttgttctgagacacagttaagttacttgaaaacagcttgatcctttcaagtcttggttttcagatttgataggtgagatcagagcaatgtttagtctagagacaatttttctccactactgaggcaaaacccttctgagtactctattccagtgtcctgtgagtcatgagattttccagtttagctggtaggaacacacactattgctagacctatgtgagtaccagggattgttccctcttatctttttgggtggctctttccccagcattatgcagtttcctcgcatgcatttgttgatcagtattctgttgactactagagggaaactctgaaggtctctagaattctctctgcagctttttcctctctggtactatgtcctgtgaactccagccaacttcgtccacttggattctcagctctgtctccttaattttagggaactcattgggctctgcctggatttccccttcctgtaccacttgattcccttaagcttttcaaacaaacgctcctgtagtttcttaagaaagagtacatgggaagtaaattttcaagaactttttgcctaaaaatatttcaagttaattttcacacttgataggttggaaataaattttgaaggcatgacttcattgtctcctggcttccattattgtgttgagacgttcactgccgttttgaatccagatcttttgaatataacctatgttttaaaatccagaagcttaaacaaaagttaatattacttttaattgacaaatcatagttgtatacattaatgggttgcaatgtgatgttttcatatatgcatacaatgtggaatgactaatcaaagccaattaacatatccattacctcaccattttttgtggtcagccattgagatttactcttttagctattttgaaacatacaatatgttattattgattatattcacactgctgcacaacagatctcagaaacttattcctcctgtctaactgaaactttataccctttgtccaacaactccccattccctcctcataccagcctctagtaaccaccattctactctctatttctatgagtttgattttttcagattccacctatgtgcgagatcatatggtatttgtctttctgtgcctggcttattttacttagcatacatcctccaggttcatttatgctgtcaaggataacaggatttcctccaacttcagtggctgaaaggtattacattatgtatctataccacattttctttatccattcatccattgatagaaacttaggtagataccatatcttggctattctgaataatgcttcagtgaacatgggaatgcagatatttctttgacatattgatttcaacttctttggatatatactgactagtgggattgctggatcctacagtagttctatttttagttttttgaggaacctccatactgttttttataatggctgtactaatttatattcccaccaacaatgtataagggttcccttttctctacatcctcaccagcacttatccttcctccttttaataatagccattacgatctagaagttttaaagatcttatctttaacccagtttttctgaaatttcatcaagatttgcctctgttatagattttcctttcctttcctttcctttcctttcctttcctttcctttcctttcctttcctttcctttcctttccctctctctttctccctctctctctctttccttctttctttcttcttgttctgttgcccaggctggagtgcagtggcacgatctcagctcactgcaatctctgcctcccagattcaagtgattcttctgcctcagcctccctggtagctgggactacaggctcacgccattacgcccggctaattttggtatttttagtagagatgtggtttcaccatgttggccagggtggtctcgaactcctgatctccagtgatctgcccaccttggcctcccaaagtgctgagattacaggtgtgagccaccgtgtctggcgcgttgtggactttttgtcattcatttttcctgggcactcagtgaatctttctaatctaaagactggtgacctctagctctgggaaatgttcttgtattatttgctaataatttcctcccctttattctttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagagatatgcctttccccttacaaatgacaccttatattatgtgcaatagaaaccaaggccttgagagactgcaacaagatcgctaatgttgtgttttgcttaaataaaaaaacacagacagtcagatacacacacacacacaccccaccatgtcacttttaacccattcttaacctttggtccatcattaacatttaggaatatggtattctaatatttctatttagatatatttcacaaacatgatatgctatatatactatattatactctacatttgaaacaatgtatcacaaacttttctctatatcattggatattataaaacctgatttccaattgcttcatgttattttatcttttgatgtatagtacattacttaactcagtctccactgttagacaatcaggctacatatggtgtgttgagtgcccttgtagttctatctttgcatacatctcaattatttccataataaaaattttatgaaatagaactgtggtgtcaaagaagacttatattttaagctattttgaaatttaatgctaatttggccttcaaaatatgtatcaatttcaatcctaatacaaatatgtaggcattattgactataggcataaaagctcctatgctgtcatttgtttgtaatttaaacgctatctcattttaatttacatttctttgatttctcataaagttggactttttaaatatatttattggccatttgtttgctttgactttgttttctttgatgctttgtgaattaaccctttttgttttgtttgtttacactcatgcttattccaagacactttaaaatctggtctctttgcctccaattttgaccctttccaatccctccactgaagccatagtagtattcctgaaacatgaatttcagcatattatttccccacctaatgcttagtgacccccatcgttcttaagataaaatccaacgtttgtaacgtggcctacaaagtcctgcatgattttgtctcattctccaggcttcaaacaagagagaacacacacacatccacatagtctttgcttagttaactcttactcattacataggtcattggtgaaaatcgacttccacatgggagatttcccttagctcccaagtctctttagataactcctgtgtatgctctactccctttgtagcagcacttctattgcccacgtaatgtctttctccttcatgatgtgtgagctcttgaaggcaagaaccacagcaaagcttgttcactttgtgtatctccagtgcccagtacagtgcctggcacattagttgtgcttaataagtattggatagatggatggaggaaataaagaagattggagaggccagaaagaaattccatgagctaattttctagattaactgttatcctaaagaagttgttgtctccttactcaccaaatcctggctattcatgtgagaccttatgattgtactgagctagtctttcatttggcctgtagtttatcactgaaacatctctattttcagaaacaataagaggtgttgttggtagatgtatagcagggtatatgtacatgaggatatgtatttttcagtttcccattcccttacaactagttcaccataaaagtttcctctctggtcttcctacattcaatgccttttctctctcctctaacctacatattattgccaagtgaatttttctttcctcaccatcatttacatgttcaaggatctcattggctctgatttagaagatcttgcacaggactaaaacatgtatattttggcaaaagctcctccagataatcctgatgtgtagcgatggctaaaaattgctgaaatatataaaatatacctcaattttttgaagaaaagaacagtctaaatggttaaggttatagaatttagaatcagatggacatgggctcaattatatttctgactcttactggttgtgtgatcttggacaagttacttagcattttaatgtgccaactttctcattcgcaaaatggaaataacatctactacatagtgttatggtaaagagtaaattagatagtgtatgtaaagtgaatgcacagagcattgtatatactaagcacccaataaatgttagcagttattttgttgttagtcattcaattgttcattcaacaattattttttcactatgtgtcaaatgctgtgttagggccatggaagatattaagaggtacaaaatatgaaccctgctcttgagactcctagatttagttgggaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatactgggctaggagatggaaactgccacattgctctaattgctaactttttaaagctctagtgatatcagcattatgcatctaagtgtaaactatttaaggaataaacatatatcctatttgttatatatcatatatggtgtcttacacaactcagataattcataaatgtttatttctctctcctttccactgtctcacaggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataactagatattgcagatttaatttttgtgcattaaagcttgtatttgaattaatttattgagtttttcagaacaaattatctgagtagtctgcgttcaagccattggagaaaaatttagaaaatgcctctgttgtcattggagaattaaaaattcccaatgatttaagaatataaattatattggaagcaattagggtaattctagttaaataatgtggaaaggtgccctgaataaggagctagcaagccagagcggggggtggtcagcctttctagtactggccagtttggccatgtagaattttgaacagtgtcaaattatcacatattatattttacttttgatgaaaacctatcatcaagggtttgttaggaaaccatgaatgtgtatatgtaatatataaagtgaacatatatgtactttatatatattcacttgtgtatgtatgtttatgcatattcactttatatattacatatacacaaaaaacttttttttccaaacaccacctcgaactagaacaaaaaactttttaatttgctaatttgagtgagaaatatactggaagggaaaataagttacaccatccatttttgtcccctaaaggaaacatcaaaatcaatcaacatttatttcctccctctatccatcattgccttcctccctcctgtcacgcacacatacacatgcaaccatgacacagataatgggaagagctttattggattagcagagatttacagacaagattgcacaagagatgctgttgctggatagaaaattgatcaggtagaagtgatgctacctacttgaggatggccatctgaattgttaaaaattctgtcatagactattaaaaaaaaagttttactactcccaagtacacacagttatgagaattaggcttttaaaaagttgcacagtgaaggctctttaggaacctactttacttaatcagtaaaaattgagtattattgatgcaccaactattcccatataaatgtacttgctttttcagataaaacacttctgaagtgctcaagaatgtctgaaaacagtttgttttcttaaataggataaataatcattccttttgcaatcttgtttacagtattcattctcttagccaatccctccacgcaaatggagacaaacttcatcccagtcctaaccagtatagttgaagggaatggagccttgtagtctatgatttttttttttaaatttccatcgaagggattggggatgtcagagagccagagctttcccctttccaggagctaagttggcttcggaagtcttctgggatttgtgaaaatattactgttgtaaaattacaaagtggtagccataacaactccctcagattggagacttgaaatgtcaaaactcccctcttcctttcccctagtttggtggatgctcatttattaattcattcaataaactattagatgccaggtaccaaactactgccatgggagtgcacatattaacaaaatgctctacctgctgccaaatggcttactattctgtggaagaaacaaagtatataatcctccccaataacagttatgtattgtttgttcacttaatgtggaaggcaagactgatgcagacacacaaggaaggctcaaaaatataaatctagcagcaatgtcatcttttttgattttaaataccatatgtgcttactgctaatcaggaaatgaacaacctcagtaaaattcatcagtgctggtaaatagtttgctgtagtggaaagctcataacctttggattcaaatgatcctagtttctgtaccatttattagcgttgtgacctaggacaagtacctcacttctctgagcctgtttcctcctctgtaaaataatgtctacttcacaaggctgtttcaaaggttaaaaaagatagcatatgtaaactgtcttagctcagcgcttgacatttcctaagtgtgccataaatattaatctctttccttactcccagctccaatacagcgtaacagtgctttaaaatgtatgtccttcatttctccttcatttctcagtcacctttgtctcttccctagggcatatccccaaattcttaaacaaaaaaaaatgatttttttccccttcatcaaacttttcactggctcccttagcacccagtagaaggtcccaactccttacagagtctgggttttcatgtccctgtttgcttacacagcttaatcttttgccactttccccctcacattgattaaggtagccaagtttaactatttacacaactattcacacaagttattctctgggcctgcagcagaaacatgattaacaattttaatgcccagagtaaacaacagaaatttttcttaaattaaaggaatagtgtgaaaatgctgtaagtacagaaaatgcaacctccattccagtagaacaatttcctttgccttgtccttggctctccaaaactgttcatttattgtggtgtcttttagattttagtgccctgggacaaagatctaatttccccaccctacttttgactctatcctggactacctttcctcacctctatctctctcaaccagactaactctttattccttagacttgatgatgcatccctctttagagatccaaagacaccccaagcatccccctctctcagcaataatcacattgtatagcagtgtttttcaaagtgtggtcctcacaccgcctgtgttagaatcacctttagtgtttgttaaaagaattgattttgggttcccactcctgacctaaccagaatatctgagaacataggcaggaatttacatttttgacaagctcctcatgattctgatgcaccaaaaattttaatgaataatcatcttccctactagactgaacaccttgagaggaaggactgtgtcttttattgttgttatattgttaatacctggcacagtgcttggaacattagcttggctaatgtttattgaatgaatgtatgaatgaaaaaatgcattatgaaagtttcctcttgtactctcatgttcgtagtgatgtttgttacttcctgggcagaaaagcttggttactactccatttgagctgtattaattctattttgcagagatatcaaggctcctacataataaatgatcattgtcctcctcaaaaactctttggcagttatcttggggaaatgtctttggagcatatggcaccattgttttcagtaacatttcagtcttgtcaaactttgttgtttgaaggtggatttacatttcggttatagccaaaaatcactcaaagctaagcctacttaaaaaagtggggaattaaactgggtttggagtaagcaatgaagtttgactctgaagtcccaaattctgagtcaaacagtgaaaaatgacttctaagatacaacatggtgacaaagtacttagtgggggtgcgatgggccccagatatttacttcagttaacttggcttttatagaatcctggcaatgccatggaccttaagagaagtaattggctacctctagctaaacccagctggacaaagagaataggacttgtatttaacattttcaaagaaggtgactgcataagcttttgttgttgttgctctactcaacctgttctccacaactgtttctaccagaagattattttatgtctgcaatttatgcttgtttccactttttatattgtcttattgaagaaagcacaaaaataatcaaaaataaagtaaaacctgttttgagagtatgaaagaaattttaatgccacattgaggttctggctacttgtaagtaagagtaactgcatctggatgtgtttttattatacaattctatgtgtatctttagatgcagtgaaattcagattgcagcaaaatcacttatctgttcttttcggctaaaacactctaggtgaattttctaaacttccatggtttacatatttatatatgactaccaagatggagcaatccacggatggacttttgaataaactcaaatatttgatactgcttcctccaaggaatggagagtgtcaggcaggtaggtaagaaccactcctacacttatttctagctcctgaagccaactgcagccttggagccaatggctgtatttggctgtgtgttacaggttggccaaactgattgccatcaggtcagacaaaactgccttttatggtgtagtctgccagcttcagacatatgctgtattgttgttattggctagactatttattagactattgttggactattttttatcaaatgctttaccccacgcctgtttgtattgggagctctggaccaatagtgtctctcctagtgacagaaatatgagcatctgtggattacacagcctcatccctctctacaatattccagcccatccaaaatgctatattatgaattaaataaatatatatgtattcatga

SEQ ID NO: 1110 - DNA, 105545 bp, mus musculus
gacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcagatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatcggtaatttttggagaaagaaagccagattttgaatagttcccctttcatattttaggaaatgtgcagaaaattctgattataaattaagtggaaactatttttactcatttttggatggagagtggaaaatgaatcattcccaactgtgtggttcgttatgttgtctgaaacatcttggactttggggaggtgagagaggtactggttgtgtgtgtgttgcgggggtggaggggtcactttggtttggtgccaagtgtaaaagaatattaattctccatgttaagcagagagaaagtctgacttttagtgtcacatatactcacttctttgggttaattttaaattggaaaatcatttaggattacccccttagtctgcttgattcttccccaaggagaaagggagaaagttggctggcaggagctatgggagagtctgcctgagtatattcccctggccctggccctgagagaagcacaggagtcctgtaggagatatatactataccctatcattcttccccatactatcattcttcccctgtatctaggaggttggctttttagccagtatctgataacagggtttatttttactttttggttctggaacttcactgttgacatttgtaactactttttatatacgaacctccctgattaggattagtggcttctaatatttatttgttcaataaagaataaataaaccattatgttatagatgaaaagtcagaataaccagaaactagcctgtctttttaacatgttctcaaagtggattagagggcttggggtacttagtttagtttcatgatcttatttagttgtccagtctaccaatagggttgagacgcaggacacatgtctttcagcaggctaccagtagttcaattaattattcaattttaaataatatttttattcacgacagttattagagcagtaagtcctatcagagtaattattttctccatcacctctcacttttcactcactagtcccaatatatatcttagttcatgatatatggggcatttctataaaacggcttcatattttagaattttcattatcacatgagtttccatccttataaaagattgttgttatcgttttaataaattttggcttcataaaagaggccaaatttcggtgactgtctattgctgatagacttcaactcaatattataagtcccatacaacttttttcttgtgctgcccatgtattttcccctctactcctctaaaacatgctaccttcatctaccccagtgagcctcctgtctgcaaaatataccattctcttttctgattcttaactgtcactagtgttcttctcttggcctgtttacaaatcctacgtattctttaatgcataattcaaaccccataagaccactccaaaacatcacagctacgtcataatctccttcaggtcagaaataatgtcttgtatttctttagtattctccttagtttctagtacacatagtattttctcaagaaatccaaatgaattcagtcttcataatggatttgcaggaaatataccagtgcctatagcttgctttggatctcatctaagaagatataaatctgtcttgccattatatataccctgaaagtctgaaaaaagatctcctgtgaactactgacaatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagggtgggttaccataggtgagggaaaagaaaaatgttgtttctcactctcagtcaggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgccatgacagaggtttgcacaggatgctctgaagcacagtggaggggtcagggaaaggatatcattgagttcaaaaacagggaatcatgagtgaatttattggagaagaaggaccaaaccggagagagtccatgcggaaagaattgacaaaacttggtgaatgactatgatgattatacaccatgaagagaatgaattaaaaaggacttttgaggtggagatgtcttgaaggatggtggtattgaggaggacaaaaatgaaattaggaaggggtggcagttttttggggatgctttgactttagatttgagtctgatgtgattgtgggtcatttaacaatcattcattcatcaaacatttcttgaacatctattaggtggcaagcacccggataggtattagggttacagtgattaagaaagcacagcctcaaccctgatggagctctcaggttagtgtggggaggcagataattaaggacacagttatgagatggtgtggtaagtgcaatgacagtggaagaacaggggctgttacagaacataggaggaatagcaagatagaatttgggtgagtttttgaatgccctgttaggggacaggagttgaggcagggaaggggagtgctctagtcaggagaaaagagtttgttgaaacatctggaggacagagagcatgggggtttctcagaactgaaagggcaagtgtcctagaaagggttaaaatttaggctttaccagtggctgaaagattgggtctggagaaatagacttgggagtcctcagcgtggtggtagagccatgcagtagtgagctgagcaaaggccaaggattgagccttgcagaacactcgtggtctagaaattaggcatgaaggaatagaagttgaaagagaaagagggggatgtgtatgagaggcaggaagtgaagaggaatagtgcaagtggaatacaaccctgagtcctccaggaaagtagagttggctttggctcactagtctgagggttatcaaaataaacactagatttaagtttttagtacaggtttacttttagaatgtccaaataataatgtatccatttgagctagagatgtaatcatgctatgcacctgaagatgggggaaagaaaagaatatgggaaggtttgggcagcatttctgataaggagagtgggggaggtgtgggtctcagctggatgatcacagagccttttgaaaagatggcaagtctttcacctggcttgagggtcaggttattctttaacaaacctgaagtagagtagacctatatgatatacatccagtgtatcaccttcatctcattctgggacgtagcctgtgtctatacaacagcaaataaatgtttggggaaagaataaattctggcataagggtgtgggcttcagtttgtgaaccagatggcatgttctgttgttgagaggccatatgtaattgatacataaagtgacagactgaagcaaaagcaaagtaagtattttaagacaagcagttaaaaaaagaaagcagactgtgaccctaaaagcatgtgaagattctggcttctggcttttggaagagctgaaaatgtcggtgcatagacaggatgtcaaaaaagagcatgtcaaagaatagtaatggggccactggctcagattatttttaaagatgaagttgtcttctgtcaatcaggaagactcaggtttgggatgaattggcctttctgccctatttcacttctccccttcctatgctcaccccaaggttcaattcccacataaaagcagtcaggatcttgtctaggtttagataatattccccttgtaccttttagacagcaagagagaatacagacattctatgacagtgccatgtttcagtggaaatgatatgtttcaatagaactaatacagattacacccccttttaggcttcagtacttactgtgtcaggttgatgtgtgtaggagtgctcatatatgtgcgaatacatatgccttcatggagtatgacaaatggagatcatggtccagtttgtgccataatggggtaatctacctcgctttaataaagaggtggtgtcttgatgtacgcctagttttcttgagagagtcaatgagaaagttacctgaaataatctgtgtctagagaagtgaaaaaaaaaaaccagcaattatttgagggttgaagaagccatttctgttaatgggatgctgtctggaagaagaatagcctgtgcccagctttctcagatggcaaaacattttcctctttgggaagggaataagagagcacaaagaggcctaatctatacaacacaataaaacttgggtaaaaatggaatcagtgtagactgccaatttagctaactgaggccttttaaaatctgttatgcaaatcagccaaatctttcccttactttgtgctgtttagacacatgtacaattttgtgtgagctagcataatgtagtcatctggaggtgaagaaggtatcacagtttcataaactaaaatggcttctgtaacatccataaaagggaagcacacaaagacccagaggtaacctcttgcagcaggaaatgggagcttcatcctgccccctggctgccaacctcctgtcctgtttcctaccagcagatatctccattccaatctcccctgccactttggctctcttgctgtcacggtttaactgtcctgagaaagttgcactaaccgggcttgaacataaggaacctggcccagtcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgctaggcatgataaggaagagtgacttccttagattgcataatcgcttcaattctctgtttccctttgcatatgttcattattgagaataaattccaatttgagaggaggctttaattccttgtaaatgaataggaaatgagtaagtaaatgttcggtgttttcctcaaattatgtctcatattgtaagaaaacagtggcaaaaagccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaatatgccatatattttatttctttatactttttatttatttatttatttatttatttatttatttatttatttattatttttttgagacagagtttcactctttttgcccaggctggagtgcaatagtacgatctcggctcactgcaacctccgcctctgcggttcaagtgattttcctgcctcagcctcccgagtagctgagattacatgtgtctaccgccatgcctggctaattttatatttttagtagagaagaggtttcaccatgttggccaggctggtcttgaactcctgacctcaggtgatccacccacctcggtctcccaaagtgctgggattacaggtatgagccacccactgctcatggtcttatttctttgtacttttctcattacattccttgtgcccggaacatcctgcccccatgcatctctgtctattaaaattctgtttatccttcaaggcccatcttaattttacttcctctttatctgtgaagtcactgtaccttgaacagagtaggtgttcaatacatttttgtattaaatttctgaactgccactttttttattcctctgacatcaatttagcttagagatcacgtccaaatcaatgattgcttcctgtattcttcttccttccccttttctttgccaagaagaccacagattgagatggtagtgggattaaaggaggccaggggagacattgtgccccaatacaagaaaaatagaataaatggtgaaaaatcacttccatgggaataaagccaaggaagccaagagagacctggcaggaagggtagcaagggttcagctggtcctcataatccagtttgagaaaatgtgaaatcacactacccagcctgcaaacacgtgtatctatgtgaatatatccatctattcatgggaacagtgccaaagatattaaggagctacaggtacttagcagacagaaaggggccaagtacacaaatctcttcttttccttcatgttccctctctcccccacatccccccatccactttttcaaaagcacgaactttgaactacaaaacataggaacaatggagatagcagcgtagcacttaacatgactgagggaaggactgctagcagaatgagggccagtaagttggggtattacatttggaacagactttatggggtattgggatagtgggtgagagagaagtagatattggggtgagtcttagaggaaaagcagctaccagggctgaaagacttgggagtggggagaaataaaaaagcccatgattaatctagagtgaaatgatactctttttcacataacgaatgggaaacagtagcttgctcaactgaaaacatgctagaattccggctactgttgtaacaacattatattcaacagatctgcaaagtacccctaatatgtacctgaaagaatctatgtaccagtaaatgatgatatgcaatggatatcttctctttttaaaatatttatttattgagatagggtctcactctgtcacccaggctggagtgcagtggtgtgatcctggctcactgcaacctctgcctcctggggtcaagtgatcctcccacctcagcctcctgagtcactggaactataggtgcatgccaccacgcccaactaaattttgcattttttgttgagatgtggttttgttgtgctgcccaagctggtcttgaactcctgggctcaagcgatctgcccacctcagcctcccaaagtgctgggattacaggcgtgaaccaccgtgcctggctgatgtcctctcttgatacagtcaggctttgcattttgaagccctgcctctcttgtgggtgaagcctcggtgccaaagaaggaaagctgtgagatacaatgctagattttgatgaattccacactcaaaatactctttttttcctgaaggaccctactgataaatataaaatattataatcaaaaacaaaaaaagtcatggaatactgcagcaaaactgtgactgagggctggatacatgggttccagtcctagttttgcacatgctagtaatatgactgtgcaaaatactttaactccactttgaagcttggtactcccatttgtaaaatactagcatcttctactttgtgagattgttatggtttttaaatagtatatatgaaattgcctggcatagtgtctggcaatcattcaataattacagatggtccctgacttaccatagttcaacttacgatttttcaatttgacagtggtgtgaaagtaatatgcgttcagtatgcttcttgacttatgttagggttacatctggataagtccatcataagttgaaaatttcttaagttgaaaatgctctctctggaacataacttcatcataagttgagggacatgtgtaatagttttcttagtctactcatctggaaaagagataataatatctgttcttcatatgctgtgggattactatgagggcgaaatgagatattgcctatgaaatactttgaaaagttaaagatattatctaaaacataaggtttctttaatgtcaataaattcctacatccacaaagtcatgaatgtcatattttccccaatagtgagcaaatgtgcagcattattaatttgtacgtagattagtgcttggctcatggcagatgctaaatgaatctttgaaacatttgtctactgactaaccgattttcacatgacattggttctcaagctcatggttcttttttcccctcttctcggttcccctctggattcataccctctgcgatgacagcaaactctggagatgaacctcaccaacctggttaagcgcaacagcgaactagaaaatcaaatggccaaactaatacagatctgccagcaggttgaggtatgtaacagaaacatttgtgatttttcagaggacctgaaatgggtgaccctttgggaggacttcagttttgtcagagtgtagcctagtcatttggaatgaaggattgaatggcagttttagaaagtctcattcctttaggatgcttgttccaaaaaaagtgtcagaaacctatggtttaaaaagaatagacggtgatgatggacagtggggggataatagttcaaggggcaacctattctcctttccaaacagcaggcaatatgaaaatcagacatgaagtgtgcttcatccatcatcaaactggacattatcactccttaaagagattactggagtgtcatagggaagttgggaatcctgggtccttggggtaaggtgaggttaattcagcacaatattgtttctgtaacaatattatcaggactgcttctcctctttcgagcctctccccctcttcatcccctgcccatggtcctatctataccatgcaccccacctggtcctcactcattacctttccacttattcttgtcatcaacaaatcatatctattttaaagttgtaaattgtaaagtgctgtaaagtgtgaggttttaatcaattgtcatctacatcaaatcttagagcagagcttagaggaagagctgacctcttcttaaatggacataataaaataaagatgttatttctctttctcaagagcatgaaacttataccatttggttttgtgttgattttgttgaagagctgatggtagggcttcaagtgtaaacagggttgggtaaaatattataggattcttcatgggcagtggttggataaaaatgtttctaattctatttagaacctgatagtctggttctaatcttacttgtatgacagacaaatgtaacagttcaagtttattttatttcaattttattaagatctcatctcttaatccaatctatagattcctatttaagagactgtggagaatcttcttgtaaggcaaagaatcctcttattatatgagtaaccttctgacccccaatcatttggatttcttaaagtattgagtttcttcaagtagagtgtacttgtatgatgagcataccatagaaatttaatccctgctgggcactccatttgtggaagagagtggtgctctacgtagggtccatagagtactggtcaaactcagatatgagactataaaatgaagtgggggattagggaagaagcataaggaatgaaaagaaagagcactagagtgtgatttggaaaactgtgctctagacttggctcttccatgaagtggtggtatgaatctaagtcatttagcttctcagtttcagtgttcttacctataaaatgaagagttgaactgataacatgaccttcgacttctttctaggtatcacaggtcatgatgctgtgaatggtaactttctttattctattctttttctctcctggcttattctttccaagaagggagaaacaaaatataaagtatttcaaagtggctttcagctaatcagaatccctctaatgttccactctgtcaaagtttctcattatgctgttagattacagtataagacatccacactggcaaagggacaagggagtattgtaagcaggagacaagataagagatcccttgatttagaatttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttgcccaggctggtcttgaactcctgagctcaggcaatccacccgccttggcctcccaaagtgctaggattacaggcgtgagccaccgggcccggccaacttcctcttaataataacaacggtgaatccaggttacttattatcctcattcaacacagagcctgtctctccaaaagccttcaggacaaacctcaggattagaaatctagttaatggagggacttgagacttcataaatgcttaaaaatacagtagaaaatgaaatgtatagtagaatactgtcagtcatgaaagtaagacactgatgggtgatttggaattttttcattatatgtaatccagattcatctatagggaatgactatattcacagtgtataccaggcatttcacattcggcgggggcggaggataccagctaaggcgcttctgagaaaactggaatagggtattttcctgtcaaacctgttccccttctttattgtctgtaaatgtttttgtcacaaattgccttttcataaaagggccataaatactgcctccctatcatggttctttctccctgttctctattctcctcagaaagtaaacaaagctgcagtcttcctattataacagaaacagagattaagatcactacagatttgttagctgacttctatggtaatgtagcttgttataattgctgctgaaggtttcagaattcagtagatgggtggttggaaaatgttttctgctgcggctggagagcatgggaaggaggtagaggcagctccaagactccctttaatctaattaaggaagggcatgctttgaccttgctatgataaccacttgatctctatatatagttctttgtcctggctcatcaggcatcctttgtttacatttccaaaggaaacctctgtataatgcatagccaagggaaaatgtataccaacagatgaatacttcctcttcgcttccaatactccatggttctgtgaataataggcattctaaaacatagcgaggggcaaatatagttaaatacttagtaatcagttggtcaacagcatttattgagcatacgctgtgtactctgtggtgggcgatttgggggctacaaaagaaatatatgtggttgatgacctccaggaactttcagtctagttagggaaaacagtatatagtgagaaagagtatttatagagcagcatgcagtgcagaaaatacaaatgaatgtagtatagccctttcaattttacttatttagtcttgttcttagcttttagggcactgagtaaattaaaacactttcctgtatattttgtgtgccacctttttcttctttccagaactgctgtgatacaatggcttaatccatcccagaagctccatgggcaggttgatttccttctggctcttctcaatccttttaaagagctggacggcactgctctttagcattaggagaaagaagaaagaaaggagatgagttggaagagagggagaggtttcccttagtctggggaatttcagctttctgtcttgctactaggtcttagcttcattcacttttggaagtctctctctttagagttcaaacttcagatgggctggtattttcttctttctgctcgtattgcccattggaaggatatttagtttgggaagggcaagaatcttggagtctatgtaatagatgtctggctgcttctccaagcataaaatataaatattttaaaataaattaatttaaaaaacactgctatggatgatttcagcagatgatccttaaatatttttgggtggttgagctagaagaaagaatagaatttaaaccattagagcacaaatacatttgttggtggagccctctttaaggagcagtcagtgaaattagtataattggaaaatttaatggagaaaatgcattttagccaaatgttgaaggagaaaaaaaattactccctctggagagacagaaagcagaggtattagtggaggtgtaaatgagcacattttatggggaaaatggtgccttaagcactgggtgtatacagataaataggaaatggcacctgccctcaaggaacacacagactggctgagaacctgacaggtaaaatggcaaatagaatgtgaagtgataattactgtaatgaatgtaaatgcgtgatgacaagttagcatggaggaggaaacactcaggcctgcctgagaaacttaggaaaggctgcagaatggaaaaaaaatgagttatcttgaaataagagtagaattttgccaataaaaatgagataagggagtgaaggggaccacatgtgagaacacagaagggtgatcagcatggagacgttcagggaactatcagaagtttggcttggccagaatgtaagacatgagattgcaagaggtgagtatggagaagtgagtagcttgggcccaaataataaagagccttgtaggccatgtataggtgtttagactttaacctgagaagtctggggagccatggaaggattttaagcaggtgaataactgaataaaatctgtatttaagaaggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaattatagatggagaaaattgtttccatgaaaaatggaaaataagttcagtgatccagtcaatctattcatttatactactgtagtgactaattcagagtattacattcaatcttattaagaatataacgattgacatttaatatagatgaaaaacctaagttaactgtgcaatccagtgtgtggtcatagcctatttttatactagaaaagaaagtgctttataatttttcagagacctaatgcattcaatcctttttaaaaaatactttgtgacaattcttcatttatgtcagtaaagtaacatttttgaagacattaaatgttgcagttgaaatacttggagggtattaacacatgacagggtttaaggataaaattagttaggattaatattgttttcctcgccctcctccctcacatctatagggcaggtaagctttcaggtgtggtcatgtcttcatagccgaaacagttcacataggaatgcactttcatcccacttttgcacttttcctttggcacagtgaagcttatcttacagtcccgtttcccatccctcctctagttctcatttctgtgttcaaattccaggtcactcactaaatgaccagaagacttgcttaattttggctcctcttgtttgctccactattttcacaatccacccaaattccccatttccagtgtgctcttggaaagttaatggaatcttaataattcagctaaggctctatcaagcttatcctataccttgaaatgtttctagttccacttttacctctaatctctcctgccatcaacccaactaaaactaaacaaatgttttaaaaacccagacttgaaaccaaaacaactatcaccacagcagataggcacacagccattgagatgtccttactgtctctgcctgtctagaggagtccagctctgtggtacggtaagcaaggattgggaggaagagaatcttacttgaataatttgttctgggcactgtgctagagacatcatttctaatctcacttagtgtttatgacaatcctgtgatacagctggttaatattcccatttttcaagtgaggaacttgaaggccagagatattagatgccttactcaaggtcacacataagtaagctgggatgcagttctacatttctctcactccaaagtctatgttctttccattgcattgtgcagcctagtggagaagttgttggtttacttgccaccgattcatttgtgctcagataggtaggaggcagctccagaaaaccctttgtttttctccactaaatagctctagctctagaaaaacatatggtctgtttgggggcctggcgttcctgaatctgtggtaagcctcttatgtactcctgccattggcctacctttaatagcccagagcagctctccatattctgacagcccttcatggggtacagaggagagggagttgcctagagttggcagaaggaagcaataatacccacaattaggcatttacttgctcagattatttttgtgccatgaggggtggaaatagtgtgggcagctccaggtatcaacactgtcctcagccatagagtttacgctgggacccatattttcttgctgagactgccgggatgggtcctcattctagggctgtacatgaccatgtttcagggtaaaagtagtctccatgagacacagggtttcttaacagttactaagagtttgacagtaaagatgtactctcaaaagtataattaatgtttgcacatttaaaacaggatataaataacaaatataataccacaatgactgcaaatatatagatttcctcaaaaaagagtgaatgcattgctattattaatggtgtcttttgatggaatgattacttagaagtacacatacagccaggaaatcagctatttactacctcaagacagaaagagaatccaatgcctctgtctattctcactacctctcctctcacctaaatcaaatcttgaatccaagtttaccctatctcagccagtcctaagaactcttaattattcctaagagctttaaatacattagctcatttaatccacacaataacccaatgaagtacatatgattctcattctcattttacagatggggtaactgaagcacacaggggtaacttatttgtataaaatcacaggtggcaaattaagagtttgcatccaattttactgaggtccttgctcttaatgactatgctgtattaaaaaagatgggcaaaactaacaacccatggctccatgtgcagtgttttgcaagtcgctgattattgtgcttatggtctgggtaaggacagaaaaccagaaaaccagtattatgtgagcgtgtgcccatgtgggaatgatgtggtgtgatactagagcaatatttgggcaagcctttctttgtgatgataatctctccagagcatgcatcataatgcctctgcacgtgctatgcatctgtctatctatttcatagatggctgtgcctggctgttcatctcttatgtgtgtctggggagggggttgtatgtgtaaagaggatatatgtggaaaaaaggatatatgcccagtgagagaattagtgtttaaactgggtcatgaggattgctttgacctgtttccctccccgcccaccccaaagggttcttttcagtcctttgatgttttccccatataaggggagaaactgggacacaactggaggatgttgccttttgttttctttaatgagaaacattgactctttccttgagagaaggttttcctcctcttctccatatcccaagcctgttccagcttctccttagtaacatcaaaggcacaaaacaatcactggctttggaataatttctaaaccaataaaactctagctaaaagtgtatagcaccagtgctagtcgcatagaacaacatagttccatcctgagctccctcatcccaatctatatatgggtagttttgcactggcatagaatggcaggtttacgaatgtccaaagatgtcttattagaaaaatctcaggtacaggggaaagcccaggacacgaggaggattagagaagagggtgagtgacctaggcagggaaggataacaatgctatgtgaaaaggaaggagaaacaattacacgatgccagtttactctatagtgcacatataatgaaactcctgccaaatttgtggtgtgttctagcatctgaagagctttgaatcttctagcaccctggggatattctgggattccaattgccacccactcaacagtcaagaaattcaaaccatttcaggaggattccattggctttagaatgaaatggaatttatattatattggtagctcacagagaacacttacatttaagaagtaaaaatatatcacagatgaatacgcaaattgcatattgtctgcaggccagagagcaaaattaaacaccttcatgctttcgtactccatttctgtcaaaaacaggatatcagcagcaaagccactgaaaacacacacacacacacacacacacacacacacacacacacacacacacacacacaacactgacctacagtgagtactgccaaaccccatgctaacccagtgacacatcattagctcagaagttgaaagcaaatggtgttcctaagtggacctttataaaaaatattaagctccactgtgggtttagcatagtgttatgtgatacagaggaatatagtagcaggtgtattaagtctctatccctgtcttcaaggactttatagtctagttgagaaagcagagctaacagtatgaagcattgccaagcaatataaaataatttaaactgtgtgacaataactgtaagtgctgtagtagttcgggggagagggagatggaagaaggctaacatcattaccatcattaacatctattgtttattaacacttaatgtgctccaggtgtcatgccaagtgctttacatgtattatctcatttaatcttctcagttacctctgagacaggcactattattatccccatttttcagatgaggaaactcagatagctaaatgatttatccaaggggagtgtagaaatgagactagagaggcatggagggacctgattacagaggacattaaaagccatgctaagaagtttggcatttattctaaggtcaaagggaagccaattgaaatttagtatgaagccattttaagcacgggtgtagtgttttttgttttttgtttttgttttgttttgttttgagacggagtctccctttgtctccaggctggagttcagtggtgagatctcggctcactgcaacctccacctcccaggttcaagagattctcctgcctcagcctcccaagtagctgggattacaggcatgtgccgccacgcccagctaatttttttttttttttttgtatttttagtagagacggggtttcaccttgttggccaggatggtctcgatctcctgaccttgtgatccgcccacctcggcctcccaaagtgctggagttacaggcatgagccaccgcgcccggcctgtagtgtgttttttaaaaagtttatactgcccctctgctgggttaagtacacattgggaaaataaatgattggagacagaggggccaattaggagactgtagtagcattgtgcttggcacatagtaggcactcaatgtatatttgttggatggatatatgaattcagggaagagattttggtggacagatctagtgaaatataagggaagatgatagaaaaggatagatttgaattatatttatgaggtaaatataggggatgtgatgattaactggatgtggggaataagaaagagaagttaagaatgaagccctgggtttctgaggagctggtgatacccttcattcatttagggaacattagagaagaatcagatttaatggaacaggatgtaggaaagagacgagttcagtttggaaacactgagtttgtagtgcctgtagttatgcaaatgaaatgtccagtaagcagttagttatataggtctaaatttcaggagagagacttaggatagacataaatataattaaggcaaatggagatctttttgaggtgatggaattgttctaaaattggattgtggtaatggttacaaaattctgtaaatttactaaaattattgagttacccacttaaaatgggtgaattttgtggcatatacattatatatcaataaagctcttaaaattaaaaaagttaagcaaggtactggcatgtagagagtaactgaagccttagaaatggatgaggtcacctaagtcagtgtgctagaactctcagaatgctgacatttaagggacagacaaaggagttggaatgatcagcaggaaaactaggaaaatttgtctcatggaagctgaaagaagaaagtattttcagaagaagtgaatagatgatcttttaaataatgatttgaaagacttaaatatcttgaaatgtcaatgggaaggagtggaaccagaagagaggttggctgaaggaaagggaagaagattaatcaaatgaggaccccaagaagctagaagaggatggaatgcaaagcctctaggagaggactgatgaactttctagagagatatatcacttctttgtaataggagaaaggaaagatgattgtttccttattgttttgtgagaatttaaaataattccctgggataaattttattttctctgtgacaaaggaagtaaaatcatttactacgattttactatgagtgagaagggaggtagtagggttgaagctttgtggatggtagagatcgctgctgtggagatatagagagagctgttaagagaaacacagaattaataagaaactttgagagcctgcttgaagttggacaccacaaatttaagggggatcaatctatgcttccatgattagcatataggtcacacttaaaaccatgaaaatgaatgaatttggccaggaaaagttgattaggtgaggaaaaggacatagatatagattagatagagataatatatattattaactttttacctgtcacgtgttgtgatattttccccccagtttgtcttttgtctttattttctgtatggcttctggtttttctggcttgtgaaaggtctccccctcctcaaactttcttttcatattttcggtggttttattttttatattttaagtctttaatgtacctggaatttgttttagaatatgagattttgaaatgtattttagggcatgtagttgtgtttcctttcagatagataactattatgctaagcccatttattaaaagaacagtccttttcctgttgagtggatatgctaccattgccatatattggatttccatatgtacttgcttctattctagactctattctgttccattgatttaattttccattcttacgccaataccttactattttgattatactgactttttggtaatatctgatatttccttactattcttagatatttgtttctccatatttttacatatttgtgtctccatatgaacttttaaataattttgtatagttacaaaatatactcagtttggattgtgattatcactatattacagttgtgtattagtttttagaagaaagacattcctatgatatgtcttcctatccagaatcacggtatatctttgcattttttcaggttttatttttgggaccgtctctttaatatttagttgttttcttcaaataggtacagtacatttttttgttgttgttgattcctaagtactttgtactcttgtccgtgctgtgaatgggttacttttctatttccatttttaaaagcatatggagaaaagcttttgattttatatattttcttgtgtattacaatcttaccatattggcaaccttatatttaaaaaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctccttctatttactttcatttttttgtccttttccagtttcttaaattgagtgaattcctgtattttccatttttatatattttcctgagtagaggtttaactgtatcccgtatattttggtatttagtgtgtgctctttcattattttctataaaattaacaactttagtttcattttcctctttgattacaaggttatttaggagtattcaagcagaaaatttccctgacccctttgctggcaggaactggagtgcacgggtgctagaactagtcagccacttcagtgccagcaggggcagactccacttgcttggccccaccgtgttccacgccttgcaggagggggagcgcaggtgagcaggtgaaggagctggggcaagcgcttttgggtgctggcaggagcgaaactgtgcttccccacagcagcatctaggggggtgtccatatctcctgaagctccagaaagagtgttacagtcagtgctcttttagctttgctgtccatgaatggcttaagtgttaacagctcagtggagggtcagtgtgacggccttttgcacttgcacttgagttcttgttcaacatccaagaggaatgaggtcgcatgaacaaattggagatggtcaatgtgggggattttattgccaatgaaagtggctctcagcaggaaggggagctggaaaggggacagagcaggatgatcattttcccccagagtctagctgtccccagctggactcctcttcgaagcaacaccgtaaagccgtccctctgaagtcaagctgcttctttccaacttccaaccatagtccccaatgtccagctgcttctcctcttctctctgctggtgaaccctggggtttttatgggcacaggatggggagcagggtggggtatgggtggttttggaaaaggcagctttcaagcgggaaaataggaatgcgtgttctcactttgggacacggttccaggcttgagggcaagacctttgccagagacctatcctcttctgcccagaatttccctgcctcctgcccctgtcatttccctcctctgaagaggctcatctaactgctggtgtaatatggacgatgactggtcttagctacttcctgtttacagggggtgtgagtatgggaagaacagcagtcagattcctccccaaggtctacctaagggtccccagcaaaagggagccattgtctgaggttctggttgcctgactgtttggagtttgatggcctctaggtgcaaagaaacaagttttacagggttaagtatgcatggaccaaatatatgtccaaagaggagttaaaaggagagaatctaatgctgaagattacagaaataagaagtgaaatatactaatcattctgaaatcaacattataccccatggtatagcacagaatggaggtaaaaacaacaagcctaggcaagactataaagaggatatccatggaaggttaattattaacacttatcttttgtgatttttagcttgagttccccaatctcttcacataggtactttgggtgctcttctgggttgatgcaggtaactctgtcagcttcccaggcctttactcgggtatagtgaatacaatgatctattccagtgactttcagtgccataagagtagaaagaagtataatccctcccaatctgggcttatagagggagaaagggaagcaagtacctttaccagtattaggtccactgggttgaatagaggtggccctagttcctgggattggacctccaacagttgtttcagttcctgttggaaatgggccaaagaagttatatgtttaatcaaatcagaggatttttggtctagcaagaaatcattcgtgagaaaaggccatccatacatcatttcaaaggaactcaaacccagctttggaggggtgtttctaacatgtagtagggctatggggagaagggtagttcaggggcgacgagtctcctaagacagcttcctgaggtgcattttgataatattcatcttttctacctttcctgaggattgtggtctccaagcacaatgaagatggtactgtatgcctagtgcctttgagaccccctgggtgacggctgccttgaacaggggccattatcactctggaggtacttagggagtccaaagcaaggaattatctcattaattagtacttttatcacctcagagactttctccgtctgacaaggaattgcttctacttagttagtgaaggtatctatccacactaggagatactggatgcctcttgcctttggcatatgggtgaaatccactgctagtcttcccctggatagcctcctgtcctttggattcctgggggaagaagctgtcgattaaggggattattttaaaggcaggtctagcaagcattaacgatctgtttaactgtatcaggtttttacctgagagcaatttctgggccaactgatgggttttatccttacgtaggtggaaagcttggtgaaggattttaagaactttccattggtcagcagcctgtagatgaagcttgctgtcctccaattgtagccatcctggggactgaaagatgtatccctgagagattgcccattctatttccacaggagaatatttagattatatttctcttaaggggccctctcagatcagtgaggcttcaagtggatcagaaatctgaggctttgttgctgctgatttagctgcttggtctgccaatctattttgcttggctacttcatccatacctttttggtggcctttacaatgtattactgccacttcacatgtgagaaaaaccgaggataatagtctattaatttcctgatggtatttaatgggactcccattacctgtgaggaagtttctcgctttccagatagtggcatgggcacagaggactaggaaagcatacttagaatcagtgcaaatgttaactgtttttcctttgcttaatttgagtgcccttgtgagggcaattagtttggctaattaagcacttgtccctgagtagagagacacactctcaacaatatcattcagagtaactattgcataccttgccttatgtatcccttgttctacaaaagaacttctgtctgtaaagagaatccagtttgggttctctaagagggtttccttgagatcctctctggtcacataggtctgtactactagctgttcacagtcatgttcaagcttcccagcttcctctgggaggaaggtggctggatttagggagggacaggttcttaattggacttcagatccctctaatagcagaacttgatacacgaggaggcagttgtctgttagccagagattccccttagaagacagcagtcctgacacattatgtggagtgcaaacagttaagttattccccatggttaacttagtagcctttggtaccagcaaggctactgctgcatctgcctggaggcaggctgtccatcttttggctaccaaatcaagctccttacttaggtagcctacaggctgctgggctggaccagggcttgtgttagcactcccagggccatttgctttgcttctgacacataaagattaaacatcttccctatggggagactaagggctggtgccttaagcaaggtttgctttagttggtcagaggcttttctagtcccaggttcccaaattagagagtgagttttagctgcctgagtatcctttattaggtgatataagggacaaactatttcaccatacccaagtatccatagtctgaagaatcctgtaatacctaagaatcccctcagttgcttgagggttttggggaggggaaaggaggagatggacttaatcctttctttgcccagtgctctggtcccctctgacaagatcagaccaaggtacttcactgaagtctgacagagctgagctttagattttgaaaccttatatcctctattagccagaaaattgagaagagccttactaccctccgagaggtttcctcagttcgagcacagaggagaatgtcatctatatattgtaaaactttaacctgaggataaaggaactcagagaagtctcttgacaatgcctgcccaaacaagtgagggctgtctcagaatccctgaggtaacactgtccaggttaactgggtagtttggttagagggatcctcaaatgcaaacaaatactgggagtcagagtgtaatggtatgcagaagaaggcatcctttaggtccaggactgtgaactgtttagttccttcaggtacttgagatagcagggtatacagattggaaaccactgggtgtaatggaaccacagcttcattaacaaggtggaggtcctgaactagtcttcattccccattgggtttttgtactcccaatatcggagtattacaagggctgttgcagggtttgaggaggccctgcaaccttgttatcaatgatggcttctagtcctttcctaacttctggtttcaggggatattgtttctgattaggaaatgaggtgggatccttaaggtgaacctggactggtatggcatttgtggattggccaattttcccttgaattgcccaaacttctgtgttaatatcagtcttcactagggggagacaaatagtttgttcagaggccaccagaatggtggtccccatactggccagaatataccggttcagcagaggagttgggctctcaggtataattagaaaggcatgggtgaacaacaagtctccccagctacaactaaagagttggaaaaaataccggattaagagcctttctgagatacccctctcatttgtgctaagagaagagaaggggcccggattggagaggagagctgagagaccaaccccagtgtccaaaaggaggtccactttcctccctttgattttcagaactacctggggctcctggatggtaatggtggtctggaccactggagctacagagaggagccctgggacccatcagtcctgctgaaccatttgggagattggctctggacctggtgaccagcctccctggggacagtctgccttccagtggtccccactacagattggacagggtcaaggtggcttcctcatgctgccttggcaatcctttctaaaatgtcctggcatactatatctgtagcagttaacaggtgcacctcaggaatcctggggtttgtgggctttcatggtggccattaaaccctctgcttctttcctatgttttctctctctctcctggacctccctatctctattataaaagatcaaggtggccactttcaggagattcactaaagtactatctggtcccagggtctgtttctgcagtttcctcctaatatcaggggctacctgagtaataaatttatcctttaggattagttgtcccttgactgaattgggagatagagaggtgtgctttaccaaggcccctcttagcctctccagaaaggcagtaggattctcatcaaatccctggtctgtcacgggtagcttcgtataactgagaggcttagttctggtcctacgtaagccctccatcatggacacctaaagtgtctcctcttccactctcccatctcaatattgggatcctatttagggtcatccaatggtactgcttcccttccaattggataaagtttgactccttccctgacaatatatgtgatactaagctcatccccaaatccctctgtcagctgcagaatggcgtgcttctcagtgttagggtttgattcaaaagtaacataatgtctttccaggagagttcagatacttgggttatattctggaaagcctctatacaactgtcagggtcatctgaaaacttgccgtgatcccccttaatctgccttaagtcctgtagagagaagggcacctggaccttactggggtcaaattcaccaggcatctgttggagaggcaggagtgagactggggcttgtccagggtgaagatttctaggagggggcaagtgagagagagaagctggatggggaggaaggggtggacccagaggagcagcgctggagggagctggctgtcctgctggaggtgtctctggggttcatttctttagttccttgggattgccacttgcagccttccctgagatggcaaaccggagggctgaaccaatcctacactatcagcaaaggtctggattacttgcaaggaaaagaaagtctgcatgtatggcctcagaccatctgtcctcatgtttacagaaaaggtccaactacacgatggtattgaaatgaatggttccttcctgaggccaagacagtccttcctgcagatcacaatttggctaaacctttgtgctatgaggcattttacctccagagtatgagggtcaaagcagttccagtgattcaggataccctccagaggagtacagactggggtggtgaagatagctggttacccattccgaaagacagggaaataggtgtctctcatttcacttccttctttcagtgaaaacttgaggtatgagggagagagaaagtgaacctcctccttttctcttccatcattttatccccaagacttggcaaccttagatggatgccacccacaggtgccattgcagcctgcactcataaaacaaggagggcctagagaataggaattgtctgcactcacctatgccttcatcccctttactgccggcaacctttgggttcccagggctttatctatgccgtggagcatggcctccttccatgaagcagaggcttaatcagcaggaatttgtcctacccatttatactgtgcctgttgcctcacttgggattcttcagatctggttttcctttctagggcttcaacccaaagtttaaaattgagtttagggcaaaaaggtgcatcagtgggtgcatggattcatttagattaagtccatgatgggtcctgtcaaacttgcagttatcagccagcggggccactcctccattgctgccctatcataaccagagtgccgaggtaggaaaagaaccctatcacatagaaaaagaaaggaaaaaaaaaaaacagctgaagagagggggaagaaccccttgctctatgcaaatgggttcctttaatcactgtattcttcccccgctttggactgagctgaactcctcagccagaggagtaaaggctctatgggcgtgtgatgggaggggacggtgagtgggaaatgctggacagctgcccgtgtggggtccctgggccccaagactgccctggggccctggctgcagctgtgattttctcctgccctccatggctgttggaagtggcacatgcatgctttggacatgcccaagtgccccagccaggaggggaggggatggagaggaaactcactgcgtgccatgcatgtctgcagctgttggggtgggggtggggatggcacctctaagaacaaacggaaatcacattgttctgaattgcatatctgattgctgggccaaatgttcattctacttaataacatttctgcagtttgcagcaaaactcttaacattataaaagaagcaataggagccatttcaaaccatagaagaagaaaggaaagataccacagaaaaatctgagcatcttggcggaccacctattacattggggatggggtccagttcaggggccttctggcaacaacgaggagtggcattggccagatgccttcagctgccccaggactttattctggtcccacatgatggctagacccatgtgaagggaagcagagccttttacccaaaagagaaatggcagggttgcatcctgccccctgcaagtggcatagatcagaggaaagtctgaggacaagaaaagacagatccacatttttgcatttactcacccttctgacgtatcccagacaaggccctaaaatggagcaggaaatttccctgacccctttgcaggcaggaactcgagtgcaggggtgctagaactagctggctgcttcagtgctggcagggatggactccacttgcttggtcccactgccttccacccatcacaggacggggagtgcaggtgagcaggtgcaggaaccagggcgagtgcttttgggtgctggcaggagcaaaacttcatgtggatctgcagcagcatctggcgggggtggggccatgacccctgaagccccagaaagagtgttacaatcagtgctctttcagctttgccatccacatatggcttaagtgttaacagctcagtggagggtcacggtgactgccttttgcacccacacccgagttcttgtccagtgtccaggaggaatgaggtcacatgaacaaattggagatggtaaacttgggggattttattgccaatgaaagtggctctcagcgggaaggggagctgaaaaggggacggagcaggaagatagtcttcccctgtagtccagccatccccgaccagactcctctccaaagcaatgctgtcaagctgtccttctgaagtcaagctgactctctccaacattcaaccatagtctctgatgtccagctgcttctcctcttctcttctctctgctggcggagcctaggttttttatgggcacagggtggtgggcagggtgggccatgggtggttttggaaaaggcagcattcaagagggaaaacaggaatggatgttctcactttgggccacagttccaggcttgagggtgggacgcttgccggggacccactctcttctgcccagaatttccctgcctcctatccctatcagtatgtttcttaattttcaagtggttaaggatttgggaatttatctttttgttattttattcttattttacaggatagtgatcagagatggtaaactataaactttttcttcatgatcaattttaaatgctccatgaatataagggaagaatgtattattctgtatgatgcaaagtttacatgtaactattatattgatgtattgatggtttttttctatagtcttatttttgtttaaaacttgttttgttagtttcacactaaaactataactgtccagtgggttcctcttgtctgctgcccagatagagctgacttatcaagcagaagaattggcaatacagagaatttaattgacatgaggtgggccatgcctctcagaatttggggactagggtttttctttctttttcttttttcttttctttttttgagacagggtctggctctgtcacccaggctggagtgcagtgacatgatctcaactcactgcaaccttgacctccctgcaacctcagactcccgagtagctgggactacagacacatgctgccatgcctggctaatttttaaatattttgtagagacaggatttcaccatgttgccaaggctggtctcgaattcctaggctcaagcgatctgcccacttcagcctcccaaagtgctgagattactagaatgagtcactgtgcctagcttagggttttccaaaggtagtttgggggaaggggtgggagtggttagtcattgccattgggaagtggttctcttgcatgctgagtcgcttctgggtcggagcacatgagtgattggcaggtacaggtggagccattcatggtcagatctacaaaaaaacctgaaaaggtatctcaaaaggccaatcttaggttctacaatagtgatgttatctgcaggagtaactggggaaattgcatattttgtgaactctggaataatggcaggtaatcatttatgtctacatcttagcagaattcaggcttttctatgctttgagcctggtggtctctcattagctttacaaagatggtcgagttttggggaagggttcttatcatttaaactataaactaagcgtctcctaaaattagcttggcctaagcccaggaataattaagggcagcttgaaggccaaaggctagatccaatttccatcactgacatcgttttctcactgttataagttttgcaaaggcgatttcaaaattgtatcttttttctatcttatccctttctatttttaaggatatttatttcctagaagtggaattgacagtttaaagtaaagccacgtttcaatgtattgacacatattgtcaacagtctctatttgccaaggcaatttatactcccaccagaaatgtacaagggggcagattttcctttaccatgctgttagagtgctactaaattcagtcacctacacttagcctttttggtcatctctcagagaaagattgttggatgctgggcagtagtagagagcaggagctcccactgggttagggttaggtctgacaaaattggtgaaggtcatccagtgggcatagtacccctgttacaaataagactgttgaacttttgaggtttgggttgcttcaatacagaaagaggtcacagaaatcagaagcagttttgattaagcagttaaatgtccccatgttcgacttaagtagttccctccacactttctgccatccctgcatcctctagatttctcactctctttgttctgcccagtgatgaccttttcttctctctggtgtgtccttcaaaacttgttttctgagatactgaaattcacaatgacatatgaatgaacagaaaccactgtacagggatctgccttttcataaaggacatacgttcctgaaagtagaattttaagcatggatggggtgtatagtaccaatgaggtcttctatttcttcactaggaaacagcactcattaattattcattagaaatatacatggtatttgaaaaaccagtattaaattcctcttcataaaatacctgattcaaacaaatcaactgtaaaagtacacttttttatgtaatcaggacaatttaagtatagaacaagcattagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagaggtaccagaccagcgtagcaacttggagttggagaggagtaggcatggaaatcaatatttatttaattcctactatgttccaggtagtgtgctaagacctttgtctctgttatctcatttgattctcataaccacttgtgaggtaggtaacattgtttctattttaccagtcagaaagatagctcagagatgttaagtgacttgtcatgaagtcacttggctttcaagcgtcaaagcaggaatgcagattcaggccagcctggcttacaatccagactttttcccactctactctgctgcctgagtagaaatggaaacttagcacaggaaaatcctcaaaaaaagggaaaggtggttttcctcaaaaataaaaataaaaataaattttagctacaaagagaccaaaaacaaaacaaaacaaaacaaaaacagggcagattagaatggaacatggcagaagtcttggccttggagttaggatgcccagtttggttgtaactctgtcatttgctagcttatatgactttgataatttactttacctctctagatctcagtttcctcatccataaaatgcagacagtagtgtctaccctatctaatcaggttgttgtgaagatcaaatatagagatcaaatatatctgaaagcactttctaggccaagccataacaactacacagctgtaataactatacaaccataactaattatttcttttactagcagtaacaatgtattaagatggccagatttttggaatttcccagcaggttgagatcccttcccgtttttgtttttgttttttttccaggagaatctcttatttatttatttatttatttatttattttattatacttttaagttttagggtacatgtgcacaacgtgcaggtttgttacatatgtatacatgtgctgtgttggtgtgctgcacccattaactcgtcatttacattaggtatatctcctaatgctatccctctcccctccccccaccccacaacaggccccggtgtgtgatgtttcccttcctgtgtccatgtgttctcactgttcagttcccacctatgagtgagaacatgcggtgtttggttttttgtctttgcgatagtttgctgagaatgatggtttccagcttcatccatgtccctaaaaaggacatgaactcatcattttttatggctacatagtattccgtggtgtatatgtgccacatttttttgatccagtctattattgttggacatttgggttagttccaagtctttgctattgtgaatagtgccacaataaacatacgtgtgctcgtgtctttatagcagcatgttttgtaatcctttgggtatatacccagtaatgggatggctgggacaaatggtatttctagttctagatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcccagctgctttgtttacctactcaagcctcggcaatggtgggtgcccctcccccagccttgctgccaccttgcagtttgatctcagagtgctgtgctagcaattagcgaggctctgtgggattaggtccctctgagccaggcgcaggatataatctggtgtgccgtttgctaagaccattggaaaagcacagtgttagggtgggagtgacccagttttccaggtgctgtctctcacccgtttctttgactaggaaagggaattccctgaccccttgagcttcctgggtgaggcgatgcctcaccctgcttcggctcacgctcggtgcgctgcacccactgtcctgcaccctctttctgagactccccagtgagatgaacccagtacctcagttggaaatgcagaaatcacccgtcttctgcgtcacacacgctgggagctgtagactggagctgttcctattcggccatcttggctccatcctcctgtttgttttatacctttttttttttttttttttgagaaagagtctcaccttgtcacccaggctggaatgcagtggcgcaatctcagctcattgcaacctccgcctctcaggttcaagtgattctcctgcctcagactcccgagtagctgagattacaggcatgcgccaccatgcctggctattttttgtatttttaataaagatagggtttcaccatgttggtcaggctgagcctaaaacagacctcaagtgatctgcccgccttagcctcccaaagtgctgggattacaggtgtgaaccactgcgcccagcccatcctaatcagggcctctgacccccttggggttttccccgtagaaacccctttgtttatttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctatcctttttttttttatacccagcacatggcttggtacacgaataggtaccgagaaaggatatttggataaacattgccatctggtggccagatgttgtaagtacaatcttttatgcatcataagggtgagtaaagcccaggtgagtaaagcacctaggaaaggcaactttttatttattttaacacagggaaaggaaatatttcagaatatgtggtctcctagaatctcctaggtctcctagaggtgttgttattccaacgtctctccaaatctttcataattcagaaaacaatatttaaatgacacaacagataaaactattttgagtgtgcaaaaataaaatgaaagagaaatttgtctcatgtaataaagaaatgtaacatagtatacaataccttttttcataatacctttatttcaatgcctacacacattcattcattcaacaaatatttactgagcatttactgtgtgacaagcactattctaggtgttagggatacagtgaacaaaaagtgcttaaacttaaggagcttacattctaatgggaggagacacacaataaacaaacatatttttattagggattataagtattacggataaaaataaactaggttacagagtggggtgagtgtgtgtgtgtgtgtgtgtgtgtgtgtgtgtgtgtgaaagagagagagagagagagaacgccagttgagcaaaggcctgaagatatattagaacttcagaaaactacagaaatgttggttgaccaggcctgcctaaaacattatgggacttctagagagttttctttcttttttctttttaaaaataagtttaatcttacataaaagttgctaaaataatacagagagttcccacatacatttaactaaccttctctaatgttaacatcttacataaccacacaactatcagaactaggaaactgtcattggtacaataattctattgagcaaactatagacctcatttgatttttaccagcttttgcatgcactcaactttttttggggggggggtggatagttctattaatcttatcacatttatagattcttgtaatcaccactgtaattaggacattattgttttatcatccccccaaaactcatttgtgctacttctttataggcacatctgtcccccagcaaccactgatatgttcatcattactataattttctcatttctagaatgttatgtaaatggaatcatatagtatgtaaaatactgtgatttgctatgtcactcatcataatggccctgagagccactgaatttgttgtgtacatcaatagttttttattttttattactaagtagtattctactatgtgaatattctacaatttgtttatatgtgcccacggtgaagagcatttcagttgtttccagttttttgctaatagaaacaaagctgttatgaccattcgtgtaaggtttttgtgtggacataaatgttcatatttctagggtaaatacacaaggatgagagctagagagttttatttcttcagagggatttataagcaagtgccatgctttacaaaacaagcagtagattggaaagaacactggataggactcagaagatctggctcaagccttgccctgtcatttagtagcaatgtgatgctggataagcctctcccctctctaggccccatatttctgtctcttaagtgatggagtaggaatcgattatttcttcagtctttttaagatctaattacatggttctgacgagatagaaaggaggtttctgcctcatttcacaaaaaattttatagctatgtacataaaataccagatgaaaaacataggttatatctcccacctttttcttccatgttccaaacagttacttggtggcttacacctgtaatcctagcactttaggaggccgaaggtggatggatcgcttgaggtcaggtgttcgagaccagcctggccaacatgatgaaacccatctctactaaaaatacaaaaattagccgggaatggtggcgcatgcctatagtcccagctactcggcggggttgggggggtttgggggctgaggctggagaatcacttgaacttgggaggtggaggttgaattgagccgagatcatgccactgcactccagcctggacaacagagcaagactccgtctaaaaaaataaaaaataaacagttactttgcttacaaagagaatatgggggagacagtaactaagcctaaggctataaaggtttggttgtctgttccctgaggagaaaggactccaaaatcaacacagaatggccacatggcataatgccattcctaaggcatgtatatgaagcagattgtcctcacgctctgtctccattatttttattagttagacatagagtaaagtacatacaaaatatatgtgtgtatatatatgtgtgtgaactgtctatgcttttaaaatatgttgtattatgcatttctatacaggtactattttttttcaaaagtcaggaaggaaatacacaaaatatttgcaatggttaactctagagattgtgattgtcgtgagaggcaactctaaaggaaaaagaagtatatgtttgtgagcacagcctctctctctctcacacacacacacacacacgcacgcatacacacagtggttaaaaccatagacatgagccagactgcctgggtgcaaatcctggctctgatatttactagttatatgaccttgggcaagttacataacctctatgttttctcggtttcttctatagaatgggaatggtaataatagtacctaccttatggggttaatgggaaaagtaaacaagtgaaaatacatgaagcaattagaatagtgcctaacatgtggttagcactataaaagtattaactcttatgtactcctcccacaagcagatagaaaacttttctgtcagtcattgtctatctgaaggcctcacgtagcatgagtccctgagcccaattcactacgatagttatacttctagaaatggcttggctgccacctccccatccacactacttttctaactttaacagccaatctcccagctacctctactctcctaatccctcaccccttccctggccaaaaaaattacacactgaagctgtagattccttaactatgtctcagtattttttttgcttgctaaactgtagttactccagtacaggtgactaaaaattctattaataatttcatttatttcttgctcctttaagtgaccaccctccctcaaatctaaagaaacaggtataaccaattttttttaaatccctgcttcatttagtcatacttacgtaaagctggaaggaccatctttgaaatgttgcagtgtttacctttagaaaacaaaaaagaagattgtctcttcttcctcttccttttgtacatttgaaacttcctgatataacagggctatagtgctggtggtgatcatgatgctagtgctagtggtagtgatgtgtgtgtatgtgtgtgcgtgtgagagagtgtgagggtgggaggagagagggagaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatctttgcaacttatggctttggcgaactcccacctatttatttcctagtattgaacagtggtaaagtccttccatcaggggccttatgtgtttgtattaagaataggtggaaattggggaagactaggtcttactctacagtcagtctttgggctgggaggtaatagggtaggatgggcagttggaaagaaatatgcaagtcaaatttttgctgccttaagaagaaagtaaaagagcaaagagcagagaagaggacctggagacttaccagggagcctgtgttgcctagtgtttaggacttggaagattgaggctaagactcttagtcataaacatcacaaactgcctcccaaaagtctttttggggtgggtggatttatacaagtaggttgccaagattgacctaatggtattttcaaggaggatagattttttttccacagacataaagccatttagacaaaaccactaacctaatacaaagagcgaatgtcaaataaagagctagggtcttccacaaaccaaccaaccagccaagtatgcttattaaggtaacccagttattttcaattaagcgttaataagcaagtgaaatacctcaatgtattatgtcttcaaacaaagaaaataccaggggctttcaaatgtcttccaagcaatttgagttgttttattcacatcacaaagaccggttttccctgaagtatttcctgttcagaaaacacttaaggaccctgctcttctggggtgcttcttgacatgaaaagattttaatgtcattgctttacctttagtttggaattgtgcctcttcagccaacttttcattctattagttgtgcctggttttatctcccctgatgtgactgtccaaaaaacattcccaccctagctccctcatttcaccttatattttctctacaaaatacactcactggagtatattttataatgcttggcattcttattttgatttttttactgtgctaaatcagtcagtaaatgtttgttgtaaggctttgtaccagttataatgggagagacaaagtagtgtaaaatcttccctcaaggagcttgctgtctaattgaagatatgtaagcaaaagagtgcttcttatatttgatatttcctttctattactgatattctccttgggtatgccctgtccacatcacaacagcctcctaaatagtcctcaggtttactattaccctccatcaaatcagtccctgttcatcttcttaaacaagttcactgtggtacttctcgcaccaccttacctttcctcccctcaaaaatactacttaaagataccatattgcctaaaaataaagttcagtctcatttgtttggcttgaaatttctctccttcacacctttttaatctaagtcttattccatctttaagatttaattcaacttccatttcatccatgcatctttccttcacttacccaccaaaagtaatctttccttttaatttcagtagattatagtctacatcacccattcagtatttaatttatgctaccttgattggtttcttttatatgtatatggctcttccccatccagtttgcaaagtttttgagggcagggccttagcataatgctttgcacagaaaagatgcttgataagatgtctggtaatgaagacatgatttttcctggcttcagagtagaggaaggattatgaggatgggtggcaaaggaaatattctggaggtagggagattaattaacgaggtttttgcaacaacagtcctatcacaataggtgataagggcttcaacctattggttccttggctcagatcctcactatattaacgaataagggtagtcaagtgaagcagtgggaatggagaaggaacaaagaaacctgtaactatttgcgatcagttggttgtaaacactactgcacttggaccagccactgaggaaatttagcatgattaaaaaggaaaggagggaaggactttgggactgctgtgaatttatgtggggacaaaggagaagtagcagtcagagtttactgaacctgagtaactgcaataatgatagtagcattgacacaaaaataggaaaatcagaggtggaagccagatctggagagaaggtgataagtttgtttttagacttactgagtttagggtaacttgagtaacaaagtggacatgtctaatgaggagtaaaagataccttttttcacatttaattcaatccaacaaataattacggagcatctactatgtgcccatcatgatagtggagctagatatagtcacataagacacaattcttgccctccagaactcatgatggagtgaggaagacagactaatatgataaaatataggaaatggtataattgaactatatatagagtatgtgaaaatataaataggggatcaattgcttgtgtccaagcaagtgagaaaaatcatagaagtgatgatctttgagaagggccttaaaagataagtagaaatgtgttcagtaaacagatggggaaatgactttccaagtaaaatgacaatctcgggcaaaggcacaggacatgaaagtgcatggcattctaggggaacaacaaggagtctgaagtgactaatgagaaacggatgacagaataaagatggatgatttgaaagagatgatgattttcagaaattgaagaaaagggtgttgttacactcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtggtgcttcaatgcccttgcatcattaatatcatcatctctacccttcttctaggagtggatcttatgagggaggtatggaagaagttgtgcatgcttagctgtcagtccgaaccttttagagccagcaggggacaaaggcaacaatcactgtgtaatactctgaaatttcttggcaggtgaatactgctatgcatgaggcaaaacttatggaagaatgtgacgagttggtagagatcatccagcagaggaagcaaatgatcgctgtcaaaatcaaagagacaaaggtaaagcgcagcacttcagtgaatccaaggaagggttgactttacaaatatcaaagtttgatccagatgattctggtttgatcatgaaatcaagaagaaatgagattatagggggagaggcaaagaagtgatgtttggcctactgctctgaatccagtaaaaacgatggccattctggggtgttagaaacgttctatatcttgacctggtttacgtgggtgtatgtgtaggcaaaagttcattgagctgtacacttaggatttgggtgctttactgttgtatgttataactcaatgaaaaggaaaaaagtaatggtagaaatgtgagtcaggattatggaccatgaattccaggatgaggactctgggcttaatctgaaaagtgttgggcagccattctcgtttcttaggaagggagaaagacggattgatatggcagaggtatgcagggtagatcagaatgggatgataccaaagtcagggtagcaagttatgagacttatggaatgatgctttgtaagagttgataaagacctaaaccagagtagtggcagcacaaatgggagggaagaacacaacaggcactgctagaaaggaaacgataggaaacattgaacttttaaatataaaagacgaatgagagagagggaagactcagtgaagacattcaggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattatcaatagagttcttactttgtactgggcattattttaagccttcataagtattaactcacttaatcctcaaaaaaactttatgaggtagatactacttttatccccattttataaatgagagaacgatgttcagagaggttaaataacttgcttacaattgtccaactagtaaggggcacaggcaagattcaaatttagggagtctagtgccacagtctacacttttacaacaaagccaagcaatttcagctctatcagatgtttttattggcatgaccttacatttctaaataacatccttacattggtagttttaatttttttcaactttagacagtatcaattaacttctgcaaatttggactttttttctgccactacttctacaaatatttttatgccacttccttcctctctattcgggattccaattacatgtatatttggctgtctgaaattgtcctatagcttaccaatgctctatttttgttttgcagtctttttatttttttgccattgtgaaaacacatgcaagtgtgtttcattttggatagcttctattgatatatcttcaagttcactagccttttcttctgtgatacctaatctgctgttaacccctccagtgtattttttatcttagatattataactttcatctctagtttgatttgggtcttttaaaaaatgtcttccatatctcaagatattcaggctgggtgtggtggctcacacctttaatcacagcactctgggaggctgaggtgggaagatcacttgagaccagcctgggcaacatagcgagattccatctaaaaaaaaaaaaaaaaaagcctgcatctggtgacatgtgcctgtagtcctagctacttgggaggctgaagcaagaggatcttctgagcccaggagttcaagggtacagtgggtcacgatgctgccactgcactccagcctgggcaacaggacaatgtcttgtctctgaaaacaaaaaaagatatttagcctttcctctagctttctgaacatatggaatacagttaaaataattgcttttatgtccttgcttgctaattctaatacctgtgtcatatctgggtccgtttcaattggttgccttttcttctcattatggattgtattttcttgattttttgcctatcaggtaattttttactggatatcagacttgttaattttctctttcgggatgctgtatatttttgtattcctataaatattcttaaactttgttctgagacacagttaagttacttgaaaacagcttgatcctttcaagtcttggttttcagatttgataggtgagatcagagcaatgtttagtctagagacaatttttctccactactgaggcaaaacccttctgagtactctattccagtgtcctgtgagtcatgagattttccagtttagctggtaggaacacacactattgctagacctatgtgagtaccagggattgttccctcttatctttttgggtggctctttccccagcattatgcagtttcctcgcatgcatttgttgatcagtattctgttgactactagagggaaactctgaaggtctctagaattctctctgcagctttttcctctctggtactatgtcctgtgaactccagccaacttcgtccacttggattctcagctctgtctccttaattttagggaactcattgggctctgcctggatttccccttcctgtaccacttgattcccttaagcttttcaaacaaacgctcctgtagtttcttaagaaagagtacatgggaagtaaattttcaagaactttttgcctaaaaatatttcaagttaattttcacacttgataggttggaaataaattttgaaggcatgacttcattgtctcctggcttccattattgtgttgagacgttcactgccgttttgaatccagatcttttgaatataacctatgttttaaaatccagaagcttaaacaaaagttaatattacttttaattgacaaatcatagttgtatacattaatgggttgcaatgtgatgttttcatatatgcatacaatgtggaatgactaatcaaagccaattaacatatccattacctcaccattttttgtggtcagccattgagatttactcttttagctattttgaaacatacaatatgttattattgattatattcacactgctgcacaacagatctcagaaacttattcctcctgtctaactgaaactttataccctttgtccaacaactccccattccctcctcataccagcctctagtaaccaccattctactctctatttctatgagtttgattttttcagattccacctatgtgcgagatcatatggtatttgtctttctgtgcctggcttattttacttagcatacatcctccaggttcatttatgctgtcaaggataacaggatttcctccaacttcagtggctgaaaggtattacattatgtatctataccacattttctttatccattcatccattgatagaaacttaggtagataccatatcttggctattctgaataatgcttcagtgaacatgggaatgcagatatttctttgacatattgatttcaacttctttggatatatactgactagtgggattgctggatcctacagtagttctatttttagttttttgaggaacctccatactgttttttataatggctgtactaatttatattcccaccaacaatgtataagggttcccttttctctacatcctcaccagcacttatccttcctccttttaataatagccattacgatctagaagttttaaagatcttatctttaacccagtttttctgaaatttcatcaagatttgcctctgttatagattttcctttcctttcctttcctttcctttcctttcctttcctttcctttcctttcctttcctttcctttccctctctctttctccctctctctctctttccttctttctttcttcttgttctgttgcccaggctggagtgcagtggcacgatctcagctcactgcaatctctgcctcccagattcaagtgattcttctgcctcagcctccctggtagctgggactacaggctcacgccattacgcccggctaattttggtatttttagtagagatgtggtttcaccatgttggccagggtggtctcgaactcctgatctccagtgatctgcccaccttggcctcccaaagtgctgagattacaggtgtgagccaccgtgtctggcgcgttgtggactttttgtcattcatttttcctgggcactcagtgaatctttctaatctaaagactggtgacctctagctctgggaaatgttcttgtattatttgctaataatttcctcccctttattctttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagagatatgcctttccccttacaaatgacaccttatattatgtgcaatagaaaccaaggccttgagagactgcaacaagatcgctaatgttgtgttttgcttaaataaaaaaacacagacagtcagatacacacacacacacaccccaccatgtcacttttaacccattcttaacctttggtccatcattaacatttaggaatatggtattctaatatttctatttagatatatttcacaaacatgatatgctatatatactatattatactctacatttgaaacaatgtatcacaaacttttctctatatcattggatattataaaacctgatttccaattgcttcatgttattttatcttttgatgtatagtacattacttaactcagtctccactgttagacaatcaggctacatatggtgtgttgagtgcccttgtagttctatctttgcatacatctcaattatttccataataaaaattttatgaaatagaactgtggtgtcaaagaagacttatattttaagctattttgaaatttaatgctaatttggccttcaaaatatgtatcaatttcaatcctaatacaaatatgtaggcattattgactataggcataaaagctcctatgctgtcatttgtttgtaatttaaacgctatctcattttaatttacatttctttgatttctcataaagttggactttttaaatatatttattggccatttgtttgctttgactttgttttctttgatgctttgtgaattaaccctttttgttttgtttgtttacactcatgcttattccaagacactttaaaatctggtctctttgcctccaattttgaccctttccaatccctccactgaagccatagtagtattcctgaaacatgaatttcagcatattatttccccacctaatgcttagtgacccccatcgttcttaagataaaatccaacgtttgtaacgtggcctacaaagtcctgcatgattttgtctcattctccaggcttcaaacaagagagaacacacacacatccacatagtctttgcttagttaactcttactcattacataggtcattggtgaaaatcgacttccacatgggagatttcccttagctcccaagtctctttagataactcctgtgtatgctctactccctttgtagcagcacttctattgcccacgtaatgtctttctccttcatgatgtgtgagctcttgaaggcaagaaccacagcaaagcttgttcactttgtgtatctccagtgcccagtacagtgcctggcacattagttgtgcttaataagtattggatagatggatggaggaaataaagaagattggagaggccagaaagaaattccatgagctaattttctagattaactgttatcctaaagaagttgttgtctccttactcaccaaatcctggctattcatgtgagaccttatgattgtactgagctagtctttcatttggcctgtagtttatcactgaaacatctctattttcagaaacaataagaggtgttgttggtagatgtatagcagggtatatgtacatgaggatatgtatttttcagtttcccattcccttacaactagttcaccataaaagtttcctctctggtcttcctacattcaatgccttttctctctcctctaacctacatattattgccaagtgaatttttctttcctcaccatcatttacatgttcaaggatctcattggctctgatttagaagatcttgcacaggactaaaacatgtatattttggcaaaagctcctccagataatcctgatgtgtagcgatggctaaaaattgctgaaatatataaaatatacctcaattttttgaagaaaagaacagtctaaatggttaaggttatagaatttagaatcagatggacatgggctcaattatatttctgactcttactggttgtgtgatcttggacaagttacttagcattttaatgtgccaactttctcattcgcaaaatggaaataacatctactacatagtgttatggtaaagagtaaattagatagtgtatgtaaagtgaatgcacagagcattgtatatactaagcacccaataaatgttagcagttattttgttgttagtcattcaattgttcattcaacaattattttttcactatgtgtcaaatgctgtgttagggccatggaagatattaagaggtacaaaatatgaaccctgctcttgagactcctagatttagttgggaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatactgggctaggagatggaaactgccacattgctctaattgctaactttttaaagctctagtgatatcagcattatgcatctaagtgtaaactatttaaggaataaacatatatcctatttgttatatatcatatatggtgtcttacacaactcagataattcataaatgtttatttctctctcctttccactgtctcacaggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataactagatattgcagatttaatttttgtgcattaaagcttgtatttgaattaatttattgagtttttcagaacaaattatctgagtagtctgcgttcaagccattggagaaaaatttagaaaatgcctctgttgtcattggagaattaaaaattcccaatgatttaagaatataaattatattggaagcaattagggtaattctagttaaataatgtggaaaggtgccctgaataaggagctagcaagccagagcggggggtggtcagcctttctagtactggccagtttggccatgtagaattttgaacagtgtcaaattatcacatattatattttacttttgatgaaaacctatcatcaagggtttgttaggaaaccatgaatgtgtatatgtaatatataaagtgaacatatatgtactttatatatattcacttgtgtatgtatgtttatgcatattcactttatatattacatatacacaaaaaacttttttttccaaacaccacctcgaactagaacaaaaaactttttaatttgctaatttgagtgagaaatatactggaagggaaaataagttacaccatccatttttgtcccctaaaggaaacatcaaaatcaatcaacatttatttcctccctctatccatcattgccttcctccctcctgtcacgcacacatacacatgcaaccatgacacagataatgggaagagctttattggattagcagagatttacagacaagattgcacaagagatgctgttgctggatagaaaattgatcaggtagaagtgatgctacctacttgaggatggccatctgaattgttaaaaattctgtcatagactattaaaaaaaaagttttactactcccaagtacacacagttatgagaattaggcttttaaaaagttgcacagtgaaggctctttaggaacctactttacttaatcagtaaaaattgagtattattgatgcaccaactattcccatataaatgtacttgctttttcagataaaacacttctgaagtgctcaagaatgtctgaaaacagtttgttttcttaaataggataaataatcattccttttgcaatcttgtttacagtattcattctcttagccaatccctccacgcaaatggagacaaacttcatcccagtcctaaccagtatagttgaagggaatggagccttgtagtctatgatttttttttttaaatttccatcgaagggattggggatgtcagagagccagagctttcccctttccaggagctaagttggcttcggaagtcttctgggatttgtgaaaatattactgttgtaaaattacaaagtggtagccataacaactccctcagattggagacttgaaatgtcaaaactcccctcttcctttcccctagtttggtggatgctcatttattaattcattcaataaactattagatgccaggtaccaaactactgccatgggagtgcacatattaacaaaatgctctacctgctgccaaatggcttactattctgtggaagaaacaaagtatataatcctccccaataacagttatgtattgtttgttcacttaatgtggaaggcaagactgatgcagacacacaaggaaggctcaaaaatataaatctagcagcaatgtcatcttttttgattttaaataccatatgtgcttactgctaatcaggaaatgaacaacctcagtaaaattcatcagtgctggtaaatagtttgctgtagtggaaagctcataacctttggattcaaatgatcctagtttctgtaccatttattagcgttgtgacctaggacaagtacctcacttctctgagcctgtttcctcctctgtaaaataatgtctacttcacaaggctgtttcaaaggttaaaaaagatagcatatgtaaactgtcttagctcagcgcttgacatttcctaagtgtgccataaatattaatctctttccttactcccagctccaatacagcgtaacagtgctttaaaatgtatgtccttcatttctccttcatttctcagtcacctttgtctcttccctagggcatatccccaaattcttaaacaaaaaaaaatgatttttttccccttcatcaaacttttcactggctcccttagcacccagtagaaggtcccaactccttacagagtctgggttttcatgtccctgtttgcttacacagcttaatcttttgccactttccccctcacattgattaaggtagccaagtttaactatttacacaactattcacacaagttattctctgggcctgcagcagaaacatgattaacaattttaatgcccagagtaaacaacagaaatttttcttaaattaaaggaatagtgtgaaaatgctgtaagtacagaaaatgcaacctccattccagtagaacaatttcctttgccttgtccttggctctccaaaactgttcatttattgtggtgtcttttagattttagtgccctgggacaaagatctaatttccccaccctacttttgactctatcctggactacctttcctcacctctatctctctcaaccagactaactctttattccttagacttgatgatgcatccctctttagagatccaaagacaccccaagcatccccctctctcagcaataatcacattgtatagcagtgtttttcaaagtgtggtcctcacaccgcctgtgttagaatcacctttagtgtttgttaaaagaattgattttgggttcccactcctgacctaaccagaatatctgagaacataggcaggaatttacatttttgacaagctcctcatgattctgatgcaccaaaaattttaatgaataatcatcttccctactagactgaacaccttgagaggaaggactgtgtcttttattgttgttatattgttaatacctggcacagtgcttggaacattagcttggctaatgtttattgaatgaatgtatgaatgaaaaaatgcattatgaaagtttcctcttgtactctcatgttcgtagtgatgtttgttacttcctgggcagaaaagcttggttactactccatttgagctgtattaattctattttgcagagatatcaaggctcctacataataaatgatcattgtcctcctcaaaaactctttggcagttatcttggggaaatgtctttggagcatatggcaccattgttttcagtaacatttcagtcttgtcaaactttgttgtttgaaggtggatttacatttcggttatagccaaaaatcactcaaagctaagcctacttaaaaaagtggggaattaaactgggtttggagtaagcaatgaagtttgactctgaagtcccaaattctgagtcaaacagtgaaaaatgacttctaagatacaacatggtgacaaagtacttagtgggggtgcgatgggccccagatatttacttcagttaacttggcttttatagaatcctggcaatgccatggaccttaagagaagtaattggctacctctagctaaacccagctggacaaagagaataggacttgtatttaacattttcaaagaaggtgactgcataagcttttgttgttgttgctctactcaacctgttctccacaactgtttctaccagaagattattttatgtctgcaatttatgcttgtttccactttttatattgtcttattgaagaaagcacaaaaataatcaaaaataaagtaaaacctgttttgagagtatgaaagaaattttaatgccacattgaggttctggctacttgtaagtaagagtaactgcatctggatgtgtttttattatacaattctatgtgtatctttagatgcagtgaaattcagattgcagcaaaatcacttatctgttcttttcggctaaaacactctaggtgaattttctaaacttccatggtttacatatttatatatgactaccaagatggagcaatccacggatggacttttgaataaactcaaatatttgatactgcttcctccaaggaatggagagtgtcaggcaggtaggtaagaaccactcctacacttatttctagctcctgaagccaactgcagccttggagccaatggctgtatttggctgtgtgttacaggttggccaaactgattgccatcaggtcagacaaaactgccttttatggtgtagtctgccagcttcagacatatgctgtattgttgttattggctagactatttattagactattgttggactattttttatcaaatgctttaccccacgcctgtttgtattgggagctctggaccaatagtgtctctcctagtgacagaaatatgagcatctgtggattacacagcctcatccctctctacaatattccagcccatccaaaatgctatattatgaattaaataaatatatatgtattcatga

SEQ ID NO: 1111 - DNA, 3085 bp, mus musculus
agctcttctcatgccgggcagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatat

SEQ ID NO: 1112 - DNA, 5672 bp, mus musculus; identical to SEQ ID NO: 181

SEQ ID NO: 1113 - DNA, 3119 bp, mus musculus
tatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggc

SEQ ID NO: 1114 - DNA, 3119 bp, mus musculus; identical to SEQ ID NO: 1113

SEQ ID NO: 1115 - DNA, 74818 bp, mus musculus
tccgggtcccgcggcccggcagaggtggctggggtgtcgctgctgtgggaggcggcggcagagtgaggggcgaggcccgaggggccggcggcggcggcggcggcggcggcggcggcggcggcggcggcggcggcgggggcttcccggccgggtgagcggctcggggggaggcggggcgaggaggcctgggcccgcagggagggcgtgtccgccacccaggaggggcggttctcggggtggcggatggggcagcggggaggatgcggcggtccgactcgggttctgttgggacagctcctctgcgccccgtaggtccctcggtcagcgccttcccttgggcgcggcgacccggcgcgggtttccaggggacagctgcccggcgcccctgaggtccctcgacaggcacggcgacccgggcacctgctgccgcgaccctgatcctccgccgtcgtcgggcaggttgcggtccccgcggttccctgcatctgttaagagggcgggggccgggaaggcggtgtccggggacggtgcccttgtcctcgaggcggccctggacgcgtcgcctgcggggcctgaaccgaggacccccccgtaccccgctttgtcctggtgaggcgctcctgccgcgcagcggcatcttcctctgttaacgtcgagaatgagtagtgaaggctgctcattatcctgcattgtaaagtaaaacttgtctttttagaagcgtctcctgaaaattggcgcatctcctgtgcttctctgggttgtattgggaaactgggccagtcgctgtcaggactgtcctgttggtaggtctcgagggaaagaaatgggagagaaacctaccccgtaaatattttcctactcaggtgcttttcgaactacctattaggtgattgcctttttttttttttttttttttcctggaacaaattacaaactgcaggtagaaatcaggaaggcctctttaggctcctcgccaggcagcctttttagcatttttctgaatgtgaacaggtccaaacgacagagcagaatttgaaaagaaaggttttgctgcagattcataacgaggactttatttttcattggtattttaatggtaatggtatagcaatgttttatttttaatgttttttttaaatggctactaaaattttattttgaaatcacagctgtttcagtcacccccaagaaacctttaaaacgtcttattagaaacatttttatatataggaacatttagccatttatacacatttctaagatagaaatcacaatgaagatacgttgtttcactattccaagttccaagtaaccatggtgaatatggtttccccattccaagtaaccattgtgaatgtggttatacacctccagtctttttctatgcagagcttaatacatgagtttttctaaagtgaattctcttttgtaattatctttttctgactagatagcatgccattatatggctgtaatattataatttatttcattggtcattctcagttcttccctattaaaatacattgttgggtaaatgtaaaagtccgcatatctatgattactttcgaatctcactctgtcgcccaggctggagtgtagtggcacgatctcggctcactgcaacctccacctcctgggttcaagtgattcccctgtgtcagcctcccgagtagctgggactacaggcgtgtgccaccatgcccggctaatttttgtatttttagtagagatggggtttcaccatatttgccaggctggtctcaaactcctgacctccagcgatctgcccgcctcggcctcgcaaagtgctgggattacaggtgtgagccaccgcgcccggcccatgattactttctaagtgtacattcctagatgatagaattattgggcagagtatgcacataagggtttttttttttttaatgtgaattgctcaatttccctctggaaaggatatgctgttttgcactcctaccaacaatctgtgagtgtccttacccacaccctagcaaaaggcaacatttaaagggatttctataggaatacttttgagccatacttgtactctccaaccaagtacaactacccctctctagtcatcacttttttcttatttgttgatagcacttcagcttctcatcttttattgcgcctttactattttggtaaagaaagcttatctaggtgaggcaaaggcgtaatagaacaaacaagagatttaaagttaggatccccttgaaatccagtatatctgattatcttgaacaagtcacttaacttttctaaggtactctttcctcagtgatgcattaggggttataatacagttgccttacttttcttaaggattattttaagggtcagttgaaacattcctggaaagtacatttagacacactttgtcttgttggtatttttaaaaattatttttaatttattatttttaaatagagacagtgtctcactatgttgcctaggctggtctcaaactcctgagctcgagcgattctcctgccttggccttgcagagtgctgggattacaggcatgagccactgcacccggccatgttattaccatctggtagaaatttcagagcacagaagcatcttgaggttcatacattttttaaagtaaataccttaattcaaaaggctattctctgataccctttgcccccatactctttcactccttaaatttgaagttttttgttttactgctgccctagattatattcaaaactttatcagggttatgaaattagatgagtgaatgaatctgcacaaatgttgaaggagcaaatatttaaaagcgctatataaagctgagagggacaggtataacgctaaataaaacacagtacttgggctcatgataaataaaacatggtctttgtgccctgcaggctacattatccaggcagcagagggcataaaagctgctttccaaatttagatggcaattttagatgtgatgcctgatgtcaactattctcaagtatgctaaagcccatttctgctgaccaagcacctgagcaagtgaccgggcagcctccacagggtcatctttctgaaggtaggattcgcaaggtgaggaagtggtagtattatagtccaagaacctgggttctactttcaggtcctccacctggggcagatcagttaacttttttgaggctggctttattcactcgtgaaatggaggtaattccagcttcctcatgtgtttgttgtgaggattacatgacatagtacgtgtacaacacttagtaaaccaggaactgctggtactcatgtcatcattcttacccactagagacttagcttccccaggaaagaaagtaggtctcttctaactttgtattcctaccccctagcagtcactggtacttagtcacgtttgataaattaacatagaatgtgaccactgataaaaattcagtttgggggtgccgggcacagtggctcacgcctgtaatcccagcactttgggaagccaaggtggacggatcacctgaggtcaggagtttgagaccagcctggccaacatggtgaaaccccatctctgctaaaaatacaaaaagtagccaggcgtggtggtgcatgcctgtaatcccagctactcaggaggttgaggcatgagaattgcttgaacccaggaggcggaggttgcagtgagtcgagatcgtgccactgcactccagcctgggtgacagagcaagactctgtctctaaataaataagtaaattcagtttggaccaatgaagaaggtaatatgtaaatatggaatattgggaaaaattgaccacgttatttggagttaatgttaaggaatcaaaggaaacattgaactaattggacttagactcatctctgctatgactatcattctactttagatccctaatgccaggcaaatagtccctccttattaagaataaatgtactggctgggcatggtggttcatacttataatcccagcactttgggaggctgaactgggaggatcacctgaggccaggagtttgagactagccctggcaacatagcaagaccctgtctctacaaaaaaatttttaaaaaattagctgggtatggggtatgcacctatagtcccagctactcaaagactgaagcgagaggatcacttgagcccaggagttcaaggctgcagtgagctatgattgcactaccgcacaccagcctgggtgagggggtgagacctggactcaaggggaaaaaaaaaaaaaaaaaaaccgactcaagtttctcccattttaaaacctcattcctagacctctaatcaccctgctgctacctagtttctctcttcccccttcccttcccagctggactgtttgaaagagttgttaataattggctttctcagtttagccctcaagacatgtgttaacagttttcattccttttatttgatctctctgcagtatttaccatgaaagtctccctttttgaaacatccttcttttgtttctgagattctgtgttccaaggttcccttcttcctcctgggaagttccttctcagtttctcctttgctggttcatcttcctccaaaggttgattttccgcaggcttgatccttcttgtgccgtactgtctctggaacaatttatagagcattgaggctatctcgtgtttgaagatttggtagaattccctgtgaaaccatctgggcctgacgctttttcatgtgatatttcctttataactttctcaatttttttttctgtggaaattggtctatttaagctttctaactctaatggagaaaattttagtgatctgtacttttctagcaaattatccctttcatctgggttttcaaatttatttggtagaggtctacaaagacatcctttattatttttaaattttttcatcttatttcctccatgccctcattttgtgtttctgtgcttttccccttttttccttaagttatctaatggtttatctattttattttgttatttttttcaaaaactacagaattttgaattattaattagatctgtttttctgtttttttcccctcattcttttcttctactttcatctttttttgcttgttttttcctgagacaaggtctctctctgtcactcagactgacgtgcagtcagtggcattgtctcagctcactgtagcctctacctcctgggctcaagcaatcctcccacctcagcctcccaagtagctgggactacagtggtgcaccaccacacttggctaattttgataatttttttttgtagagacaaggtctgcccatgttgcccgggctggccttgaactcttggcctcaaataatcctcctgcctcagtctcccaaagtgccggaattacaggcatgagccactgtgcctggcctactttaatctttattatttacttccatgtcctttcttttggtttattttgttattttttaagtttctttttttttgaggcagggtctcactctgtcacccaggctggggtgcagtggtctatcatagctcactgtagccttgaattcctgggctttagcaatccccctgcctcaacctcccgagaagctaggactacaggcgtgtgccaccacgcctagctaatttttttttaattatttttttgtagagacagggtcttgttatgtttcccaggctattcccaaactcctggcatcaagtggtactcccaccttagcctcccaaagcagtgggattacaggtgtgagtgcacggtgcctagcctatttttaagtgttttttgaccttggaataaaatttacttatttttattctttcatttttactaataattgtgtttagtgcaatgaattttcctctgattactgctttaaatgcatgctataaaattggatttgtaggctggttcgagtgcagtggtatttacaactaatcgatggcaaccagttacagatttctttgttccttcttcactcccgctacttcacttgactagccttaaaaacataaaaaagtaaataaaaaagaatctgatatgtaatgttttcagtgtcgttatttctttaaaaatgtataattttggccgggctcacgcctgtaatcccagcactttgggaggccgatgcaggcagatcacctgaggtcgggagtttaagaccagcctgaccaacatggagaaaccccgtctctactaaaaaaatacaaaattagccgggcgtggtggtgcatgcctataatcccagctactcgggaggctgaggcaggagaatcacttgaacctgggaggcggaggttgcagtgagccgagattgtgccattgcactccagcctgggcaacaagagtgaaactccgtctcaaaaaaaaaaaaagtataattttagttctaaaatacccaggagttgcttaatagtaggctattaaatttctacatggaagaggctttctgttttttaaattattgttaataaattctagtttcattgcattataatcagacatattgtttgtaatatttccactttattgaagtggaaatattttttctttgtgacctaatatatgattattttgatgaatgtggtgtgagcagttgagaagaaactgtattcattagtatcagagtgtagagtttgataaacattagtaagagttactctattgagtatgttgtttagattttaggtctccttatttttggttcacctaatatgtcttgtacaaagaatgatgtattaaagtctcctattattagtgtgtttccagtgtctcctcgcatctcttgtagtttttgtctcatgaaggtgattgctgtgttatgtttatataaatacatatatttatatgttatatcttcattgtggggtgtggcttttgggattaaaaagtgtctttttgtgtcacagttaatgctttaggacatggattctgctttgcctgagaccagggttgccattcctagtctttttttttttttttttttttttttgagatggagtcttgctcttgttgcccaggctggagtgcagtagcacgatctcggctcactgcaacttccgcctcccgggttcaagcgattctcctgcctcagcctcctgagtagctgggactataggcgcgtgccgccacgcccagctacatttttttatatttttagcggagacggggtttcacggtgtttgccaggctggtctcgaactcctgacctgaggtgatccacccgccttagcctcccaaagtgctgggattacaagcataagccaccttgcccagctgcctactctccttttgtttccatttgcctcgtataccttttccagctatttatgtatttacttatttatttagagactgtgtctcactctctttcccaggctggagtgcagtggtgtgatcttggcttactgtaagctccgcctcccgggttcaagtgattctcctgcctcagcctcctgagtagctgggaccgtaggcgcatgccaccatgcccagctacattttttttatatttttagtggagacggggttttgccgtgtttgccggccttgtcttctgacctcaggtgatccacccgccttggcctcccaaagtgctgggattacaggcatgagccaccatgcccagctaatttttttgtatttttagtagagacggggtttcgccatgttggccaagctggtctcgaactcctgacttctggtgatctgcccgcctgcctcggcctcccaaagtgctggggttacaggtgtgagccactatgcccggcctaaccttttatttttaaccattcagaatcactttggggctgggtgttgtggctcacgcctgtaatcccggcactttgggaggccaaggcaggtggatcacctgaggtcaggagtttgagaccagcttggccaacatggcgaaaccccatctccactaaaaatacaaaaaaatttagctgggcgtggtgctgcacacctatagtaccagctacttgggaggctgaagcacgggaatcgcttgaacttgggaggtggaggttgcagtgagtggagatggtgccgctgcagtccagcctgggcaacagagcctccgtctcaaaaaaaaaaaaaaaaaagaaaaaaaaaaggaatcactttggtttagatatgtcttttgtattgtaaaagttgttgaggtttcttctgttagtcaaattgaaaatttttattgtaataggtggattaagcccacccacatttattgttaggactgaaaaatttgacctcaaatccatcataatattttataattatgtgtatttgttatctttgccatttctctatgcgaggtagatattttgctcttttattacaaaaattagggtgtgtgtgggggtgtatttaggaaggtttgcatttttgttctaatcgtttacctttgtacttacaccttttaaaataccctcactcctttgtttgcttatttttctgtgcatgtgtgtgtgtgtgcgtgtgtgtgtgtgtgtgtgtgtgtgtgtgtgtgtgaaattgcatctatgtaatcaaagtaggataatgatagacaactgtggaattctgtatctacttcgtgctcctccttactgaagaactggcaataacagataacagctacccaccgtggccaagataataatccatgatggtctcttcaggtctaccttccccttctcactattctactgattgtgctctttttctgtgggctctgacttggtgcgtttctgtgatgggagtgtggcttttttgtttgtttgtttgtttgttgttgttgttggagagagggggtttcactgtgttgcccaggctggtctctaacttctgggctcaaaggatctgcctgcctctgccttccaaagtgttgggattacaggcatgagccaccacgcccagcctgaggcttctttgttgcaaaggctttcctggggaatttttattctttgcatttgtaaatgctgaattcacatttagtgtggaatctctgtcagttgattttttttctgtaacagctttgttgagatagaattaacataacacaatttacccatttaaagtgtacaattcagtgttttttagtatattcatagagttgtgcaaccatcaccacagtctaattttagaacattttcttcacccccaaaaagaaactctgtgcccattagccatcatttctcatccccccaccccttctcccacccaggcaaccaccagtctactttttatttctatggatttgcttattctggacatttcatataaagggaatcatataatagtggtcttttgtgactggcttctttcgcttagcatgatgttttccaggtttgtctgtgttgtagcatgtattggtacttcattcccttttatggtcaaatgatacatattccattgtatagtgtagtattaatatgctcctatggatatttgtatacaagttttgtgtagacatatgttttcatttctcctgggtatctatctaggagtggaatagttgggtcatacagtaactctatgtttaacttgtgggggaactgccaaacttttccaagtggctactctattttacatttctaccaggaatgtgtgagggttccaatatttctacatccctgaaatgcttgttattttgatgatgcccaatttatccattttttcttttgttgctttgttttttgttttgttttgattttttttgtagcagcaattggaaataacgttgctttgtttttgatatcctaacttaaaaatcatttcctgatccaagatcatacagattatttttatgttttcttctaagttttatagatttaactcttatatttaggtccttaatccattttgagttaatttttgtatatggtatgaggtagggtcaaactttaaccttttgcttgtcgatatccagttgtctcagcacccggtgttgatttgtttaacctcttaatatctggtgtatctattttttcctgccagtatcccttaaacccacctattgtgtacatagcagtggaactgcttctactgttctctcttgctttctcttcttctcccgttttctagttgtactttctttttttaactctatcacaatgtgtagcaatttttttttttttttttgagacggagtcttactctgtcgcccaggctggagtgcagtggtgcaatcttggctcactgcaacctctgcctcctgggttcaagcgattctcgtgtctcagcctcccgagtacctgggactacaggtgtgcaacaccacgcctgtctaattttttgtatttttagtagagatggggtttcaccatgttggccaggctggtctccaactcctggtctcaggtgatctgcccacctcagcctcccaaagtgctgggattacaggtgtgagccaccacgcccagccaatgtgtagcaattttacactaatcttccgccttcatccttatctttcttttagtgtcttatatgtacatttacatatttttaaatgctcacaatcagtccttttgctgacatttcccccatttagttgaataaagctcatcctccagtatattcctcagaaagggttagtgagtgcagaattccctatacccttgtaagttgaaaactgtttttcttgttgccttgatgtttaaggaacttcgtgactgatgtaaaatcctcagctcacattactttcattgagttttattttttagtgctgctgtttctcaccttgctttgtattttgtttttgaaaaatctcataatctgatactgatccagttcttttggacttttaagttatttattctttttgcctgggagccttgagaattttatctttatgtttgaaatcacatagtttttattaggctatatttcagacttacttgttctagattaattttccaaggtacctgtgagaccttaaatgtatagattcaggtattttaggtattttaaaatttctggaatgttttcttgcattctgagcaaattatagttttaaatattagtttagttctattgtttgttttttcttcttcagggactgcaattatatgaatattagtttttttctctacctatttgctatttccactactttgtctctgaccctttctttccctctccccactattctctctctctctccctttccctctccctcaatgtcatttttattttcttggttgttttcatgccagccttcaatgttccttattaaattttaatttgagtttattctctcttgggcacattgtaatttattcctcacttttgagatagttgagtctttttctctcatttttttttcttgagttcagttaacttttattctttcattttttcattttttatttgtttttcatctatttctgttcttagtttgtgaatttctgattcaaggtaggttttttaatatcctcaaatgattttgaatatatttaattctatttgtagtacaggcatacctcagagatattgcgggtttggttccagaccaccacaataaagtgaatattgtaataaagtgagtcacacaatttttttgtttcctgatgcacataaaagttatgtttatgctatactgcagtttgttaggtgtgcaaaagcattatgtctaaaacaatacataccttaatttaaaaatatattattgctaaaaaaaaaatgctgatggtcctctaagccttcagtgacgcatcatctttctactgatgaagggtcttgccttagttttatgggctggtgactgatcaggggttggttgttgaaggttggggtagctaaggcaattttttttgggagggggtggagtcttgctctgtcacccaggctggagtgcagtggcacaatcgtggctcactggaacctccaccttctgggggttcaagtgattctcctgcctcagccttccaagtagctgggattataggtgtatgccaccacacctggctaatttttgtatttttagtagagacggggtttcaccatgttggccaggctggtctcgaactcctggcctcaactgattcacctgcattggccttccaaagggctgagattacaggcatgagctaccacgcccagcctagggcaatttcttaaaataaggcaacaataaggtttgttgcatcgatcaactcttcctttacaaaagatttctctggctggatgctgtggctcacccctgtaatcccagcactttgggaggctaaggcaggagtatctcttgaggataggagatcaagaccagcctgggcaacaaagtgaaaccccatctctgaaaaaatataagacaaaaaaaaaataaataagagatttctctgtagcatagatgctgtttgatagcattttactcacagtagcacttccatcaaaattaaagtaaacctgtcaaaccctgctactgctttatcaactaaacatatgtaatattctaaatccttttttataatttcaacgatgttcatagcatcttcaccaggaggagattccaatcaagaaaccactttctttgctcatctgtaagaagcaactctgcatacatccaagtttgatcatgagattgcagcaatttagtcacatcttcaggctttacttcctcttctagctctcttggtgtttctaccacatctgcattgacttcctccactgaagtcttgaacccctcaaaatcatccgtgagagttggaatcaacttcttccaaacccctgttaatactgatattttgacctcctcccatgagtcatgaatgttcttaatggcatctagaatggtgaatcctttccagaaggttttcaattgactttccccagatccatcagaggaatcactatcaatggcagctatagtcttacaaaacgtatttcttaaataacaagacttgaaagtcaaaattactccttgatctatgggctacagaatgaatgctgtgttagcaggcacaaaaacagcattaatctccttgtatatctccatcagagctcttgggtgaccaggtgcattgtcaatgagcattaatattttgaaaggaatcttttttttttttgagcagtaggtctcaacattgggcttaaaatattcagtaaaccatgctgtaaacagatgtgctgtcactcaggctttgttgtcccatttatggagcacaggcagagtagatttagtataattcttaagggccccaggaattttaggatggtcagtgaacattggcttcaactgaaagtcatagctgcattagcccctaacaagagagtcaggctgtcctttaaagcattgaggccaggcatttacctctctaattgtgaaagtcccatcttccaagagaaggctgtttcatctacactgaaaacgtgttgtttaatgtaaccaccttcatcagcgatcttctggataacttgctgcagcttctccgtcagcacttgctgcctcactttgcccttttatgttatggcgatggcttctttccttaaacgtcacaagccaacctctgctaacttccaactttgcttctgcagcttccttacctctctcaggcttcacagaattgaatggagttagagtcttgctctggattgggctttggcttaagggaacgttgtggctggtttgagcttctatccggaccactcaaactttctccatatcagcaataagactgtttcactttcttattcatgtgttcattgaagtaacacatttaatttccttcaagaactttccctttgcatccacaacttggctgtttgacccaagaagcctagtttttggcctttctcagctttcgatgagccttcctcactaagcttaatcatttctagcttttgatttaacgtgagatgtgtgactcttcctttcacttgaacatttagaggccattttaggattattagttgacctcatttcaatattattgtgtctcagggagtagggaggcctgaagaaagggagagagaaggaagaatgccccatcagaacacatactacatttattgattatgttcgcatcttataagggcatggttcatggtgcccccaattacaatagtagcatcaaagatcacagatcaccataacagatataataatagggaagaagtttgaaatactttgataattcccaaaatgtgatatgacacagagacaagaagtaaacacatgaggttggaaaaatggcactgatagactcgttcaatgcaggtttgccacaaaccctgcatagtaaaaaattctgcatttgtaaaaaatgcagtatctgtgaagcgcagtaaggcagagcacaataaaatgagatgtgcctctacagacttactgtttccttttgcttcatggttttttggggagaaaattttcgcaggtaggaaattctgttttctggctgggcatggtggctcttgcctgtaatctcagcactttgggagactgaggcaggtggatcacctgaggtcaggagttcgagaccagcctggccaacgtggtgaaacctcgtctctactaaaaatacaaaaattagccaggagtggtggcgcatgcctgtaatcccagctacttgggaggctgaggcaggagaatcgctggaacccgagaggcggaggctgcagggagccgagattgcaccactgcactccagcctgggtgacagagcgagactccatctcaaaaaaaaaagaaattctgttttcccactctcttgtcaacacatgggtgccatcagactttaaaatttttgcaaatctcatgagtgtgaaataatatctcattattttcatgttatttcctggattcttagcagggtggagtatcttttcatgtgtttattggacatttgtatttcctctttgttgaaaactggaagggtggagctgccatttactgagatgggacagactgtaagaggagaaaatgttggagggagatgaggagtttgctcatggacatgtttacagaatccagtgggctgttggatatgcaaggctagagtgcatgggatgggtgtgagctggagttataaatttgaggttgttagtttatagaggatatttaaaggcatgagactgaatgagagtatggacacaagtccaaagaccaaagtcactatttagaggaagactgggttcactcttaagggtcagggtgatgacagggaagatgaggagaaatggcaaaagagacagaaggaattgttatagaggtaggaggaaaaccaagaaagtgtagtattctggaatccaagtgaagaaaatgtttccaggaggaaggtgtgtgaaatgctcctggcagccatgtgtggtggttcacgcctgtaatcccaatgctttgaaaggccgaggcaggaggatcgcttgagcctaagagtttgagaccagcctggcaacatattgagtcccatctgtacaaaaaattttaaaaattagctgggcatgggccgggcgcagtggctcacgcctgtaatcctagccctttgggaggctgaggcgggcagatcatttgaggccagaagttcaggaccagcctggccaacgtggtgaaaccctgtctctactgaaagtacaaagattagtcgggtgtggtggcgcacacctgtagtcccagctacttgggaggctgaggcatgagaatcacttgaacccgggaggtggaggttgcagtgagccgagatcgcagcactgcactccaccctgggtgacagagtgagactccatctcaaaaaaagaaaaaaaaaggaagggaaaaaaaaaagaaaaaagaaccatatagtaaatattttaggctttgtgggccacgtacagtctctgtcacatattcttcttctttttttttttttaacaacactttaaaatgtaaaaagcattctcagctcaggctgtatgtttaaacctcctctcttatctatcaagcagctgaactagtacttctcgttatcagctgatgcccactaagcaattgcaaacaaagttaactttaaaaaatagctttatagtttactggtttaaagtgtgcatttcagtggtttttagtatgcttgcagagttatgcaaccatctccataatatctgatctaattttagaatattttcatcaccccaaagctaatgtttttacagctttgaggtataatttatatgcaataaaattcaccatctttgaatgaatagtttgaaatttatttatttatttatttttttgagatgcagtctcactctgtcacctaggctggagtccagtggtgcgatctcggctcactgtaacctccgccccccgggttcaagcgattctcctgcctcaacctcccgagtagctgggactacagccacgcgccaccatgcctggctaatttttttgtatttttagtagagatggggtttcaccattttagccaggatggtctcgatctcctgacctcgtgatccacccacctcagcctcccaaagtgctgggattacaggggtgaatgagctgccgtgcctggcccatttgaattttaataaaactaattttaatattgggtgaaggaaagtgttcttaataatacttcttttatcacatgcaataaatgtcgcttgtaaatattttctcccaagtgatgtccacttttcctttaaaactagtggttctgtagcccctggaccagcagcatccacatcacctgggaacctgctagagtggggcccaccccaggggtagggcccagcaatctgtattttaaccagccctccaggcgattctaatgcacactaaagtttgagaactactccagtgtatattcctgcatggaattgctgggctgtgggatatgggcatgttcgactttattgggtatttccaaactacaggtgacacttgaacaacatgggtttgaactgtgtgggtccacttatatgtgaagtttttcccaatgaaacgggtatagaaaatacggcatttgagatatgtgaaagctgcctatacagagggacttggatatgcacggattttggcgtatgtggggattctggaaccaatcccctgagtgtaccaaggggcaatggtattttcaaactggttatactgtaccatgtacagttcacctagcagtaactgagagttcccattttcacacatctttgccaacactttggaatatgcaacttaaacatttttggcctatctgatgggtgatcatagccctttggcatatcaaatggctatgatcttaatttgtattttcccaattgctaattaagttgaacatctcatacgttcataggtcatttgagttttgtgttctgtgataatggagtcttttgcctattgaaataaatacagttatgtaaataaatacgatgtgttgaaataattgcaaaataaacccagaattcccaaggagaaagaagcccagagggaaaaaacagaaagtccaggaaagagtcctaggggatgtgatagttacacaatcgggaaagaatagggatttgtcaagctgaccgagggaaggccatccatgtgctggacgagcatggcctgatcagggaaagcaagtagtgtggtgtaggggactagtagggtgtgtgggggaaaagacacacataaggctgggagaaaggtaggaagcaactagatgtatctatcttacatttgtttaatcttttttgttgagcatttgggttattagttttcttgagctttttttctttcctattataaataaaactgatacaaacatcttagtgtacacagctgatttttttcttttgaattattttttaaaacaagtttaaactgaaattactagattaaaggaaaggaggtatgattagtttcatagtttcttgtaagaaacatgtatgtttcaagattactctccattagtcattagggaaatgcaaatcaaaaacacaatgagataccacttcatacccactaggatggctatagtcaaaaatatagtaagtgttggtgaggatgtagaaaaattagaaccctcatacactgctggtgggaatgtaaaatggtgcagctactttggaaaagtttggcagatcctcaaaaagttaaacatagagttaccaagtgacccagtaattccacttctaggtatatacccaaggaaatgaaaacatatgtccacataaaaacttgtacacaaatgttcgtaagagcgttatttataatagctgaaaggtagaaacaacccaaatgtgcatggagaggtgaatgaatgaacaaaatgtaatgtacccatacaatgaaatgtctattattctaccataaaaagggatgacgtactgatacatactacaacacaggtgaaccttgaaaacatgctaagtgaaagaagccagtcacaaaaaaactacatactgtttgattccatttgtatgagatgtctcaaataggcagatccatagaaacgggctaagcaggggaggggagaagtggggattcactgctaatggggtctcttttgggaggatgaaaatgttctacaactagacagtgataatggttgtatatcactgtgaatatactaaaaaacattgaattgtatactttaaatgggtaaattatatggcatgtgaattcaatatcaataaatatgttttgtttttaaaaatggaaaaaagattatgctccagaaaaattttcctttctcattatcatcagcaatatttttgttcccacccgcccccaaaaaaattaccacctttgggtttattattttcattaaatttaataggtatgaactgatacccagagtttatctagtgaaattataagcttccctattgaatgtaatctctatcagagcaggaagttttgtctgtttttgttcactgctgtagccctagaacagtgtctggcaaataattggtacacagcaaaatttgttaaatgaatacattttgatacttttagttactaagtaaacattttttcctttagtgttttaatttcataatactttgtgagctaattgttcttagcctcaaaatctttttagaaagaggctgtgtataactaaatgaattgaattgattgtacttcctttaatgagtgatctagttcaagttctttgacttgatatgcttttactttcttttgaaattcaggataacagtagtttgcaaatgtttgagtatgaggaccgccttttaaactgatgtctacataataattgtactttttgtatctgtgggtggaaaaactgcatagtgacaagaagcctttatattttagtttcaccatagtgtcttcagaaatttgcaaaatcgaggtgcataatatatgagacatacacttatttattctgtggtctgtgcacggtagctatatgataattcatgagcccatggcagtcgttctagaagccaccaggggtttgggaccactaagttaggaactacttaatattcgtatcagaactgaggaggactactgagttgtaaataatagctagtataggagattatacctacttatgtgtttttaaaattcagtttccgaagctatcagtttcttttaaagactgaagaatatttgaaaaatcaagtttagaagtgccttttaaaatttacttatttgacattatttgttttagcaaaaaaccagaagcaaactaaatgtctaataatgttcaattatattttgggcatatttgtctggtggaaagttaggcagcagttgagtattagaaattgtaattctgaccggatgtggtagctcacgcctgtaatcccagcactttgggaggccaaggtcggaggattgcttgaactcaggagatccagaccaacctgggcaacatggcaaaaccccgtgtctaccaaaaatacaaaaattagccaggtgcggatgtgcacgcttgtggtcccagctacctgggaggtcgagcatcgctggagcctgggaagttgaggctgcagtgaactgtgatcgcaccactgcactccagcctgggagaaagagcaaaaccctgtctcaaaagaaaagaaattttaaaagaagaaattataattcttagaatctaacaatttaaaaagcagagtataccatcacgtattcctaaacatttaaactgtgattatatgaagtgtttctgtacatggtgaaagacaggaaagtagtagtgcttgtattcagatagaggaattctgggtaatttttcctctttttggaatacttatttagcagttgctgttgccagacaccaataagctctttttatgatttaatttaggggtcattaaactacaatgcatttgacttgccgggcctatttttgtatgacccacttgagctaaatagtttttgtacttttatttttttaatttgaccaacatagtgcctttaacctagtatattcaaaatatttcaacatgtagttaatattagaaatacatcaataaaatattttacattttttatatgaactctttgaaatctgatgtggattttacacttacgacacatctcaatgttgtcacatttttacatttttaaagagttgctttaaaaaaaagaagaaacagatgtgacagagaccttacatggcctgcaaagcctaaaatagttaccacttggcactttgcagacagtttactgacccctgatttaattcattttatcctgacaacattccaataagaaggggtgctattattatcatttccatgttagagatgaggaagctgaggcacaaagggtttaagtcaattggcagcattcgctatgttttagatcaaattgtagggtctttctacaaacctgctaatcctgtgtttctttgcagtgtaaaaagtggatagtggctcacgtgtcaaaggatggcacggtcacgatctagatcccccaggtggaaacacaggtgagcagttcttagcagagtaagcttggatttgggatgtgctgtgactttcaatttcaccagtactagtaaacacttaagctcatgggacctggttattcacagtaggtactttatcatagtggaggttgtatttctacattctagtagctgacagctttgtttaatcatagcaggtggctagagttaaataatgaaaagcagtgcagtggccacagcaagagagagtgagaaatatctttgagagtattacattttttgaattagtgagcagtttagaactcctcagtatggatttcattttattttttcataattaatatgtttaaagaaatttcgagttagaaaatagggagtttcctctttcttcttcatggcagaataatagagttttgaatagttcgattatagtccatttctccttccttcttggtagtatcaaaattatgtatcattagattggaacaatttaaccagtctttattgtacacctgctacaggcaggttcttgggctacaaaggcaaatatgccatcttctttggcctcagcaagcacgtggttgggctgggagattgacaccatggccaactatgatacagtggggaaaatgctgtgctacttattgggacaaaggattctggatttctagggaggaaataattctgtttttgtggaggaaaaagagggtactaagaaagtcttcaaagaagagatgaaaacaattttatctgggcgtttcaggatgtgtagaacttctaaaggcagaaagagtgaagagaaatattctagttaagggggagagcaggagcaaaggcaccgagctgtaaatgtgactagtattttctaggacttaaaaaggaccatcatttcacacaaaaaaggcagaccaagatttttcatgttaagataacttgcccattttgcttgtgcatttcagttatgcagtaactaatcaatcattttgtcaacagttttcattttgtaattcacaggagccacttgcaatggcaaggaacttgagaaagaaaagggaatgtatagaagtgaatgattttaacagggtatcacagaggtcatttatttttattttttttatttttattttgttttgagatggaatctcgctctgtcgcccaggctggagtgcaatggcgtgatctcagctcactgcaagctccgtctcccgggttcacgccattctcctgcctcagcctcctgagtagctgggactacaggtgcccgccaccacgcccggctaattttttgtatttttagtagagacagggtttcactctgttagccaggatggtctccatctcctgtcctcgtgatccgcccgcctcggcctcccaaagtgctgggattacaggcgtgagccactgcgcccggcccacagaggtcatttcttgataagacaaaaggcgctgatgaggggcacaagagaccctgccaagcttagtgcctgagttccaggttccttctcaggtttctttgttaagaactataaaggatctgatattttaccttacttgcaaactaacacattattagcctgccacagggcactcttgggtcagagacaaaggcctttattactcagaatacagcaagcagcttgagcttcatgttcctgtcattccccccaccctctgggtcccgtgagggctgggactgcagagccactgactggatggatgccgtgaggcagcgagctttccatacaggcagtggggttatagtacaactgaggaacatgagtcccttatcaggggctgcagataaacccatcatgcagcctttgccttggaggagacatttattttattatcctggacagcaaacacatcagcccttttccctgagtgagaccctatctctatcttgcaacactgccttagaacaaaggttgtcagtgcctctgctcacagggcgctcgcaaggcgtgcagaactcaagagactgtggagaattatctcccaacagactccttgagtcttttttgttcctttaggaaaaccaaaaacaatagcaactgttccagcaaacttcttcggaagaaagggacactgtgctatgaaacatataaaatagcatatcaaaccgatattgaatgtgaagtaaggattaaaagtaagttattgggaattccatccagactgcaagacctttgactctggctgccagcttttctccttggctgtgaaagagatgaaatcttccaggaagtcctcagaggctccacttgcttcctcctgtgatgaggtgtagccagctggatggcagagtttctgctttagctaaataacacttgccagtatgtctagcttggtgactccagagggcaatattgccaagttcagtatataactcctagtaggtacatgaggaaggtagatctgcctcctttcttgtagggagggcacagacttatcatcgaaaggaaagggtttcactcatggttgcgccaactccatggcagcttctaagagagagccataacagaagctgcaaggatcgcttcctcattgattagaagacattaaaccctcagggaggagatggagaaattgggcagctcagatggtggaaaggtccccaggtgcaaaatggaactttattgtgtcccagatagtggcacacctctctttacgtctaggcaacccagactggtttccctggatacagaagccttccgccttagtggaaacacaagcctcaatgttggcaatgctgaggtatggagaaggtagttccataaaggatgtgctgtccctggagagcattgtagctgctttaaagtataacttcaccgaagttacaagctctgttcgaacagcacatctttccatagatatgcaaaggaacagatctgggaaagaaaagcaacttacctatgttagaggtatttctggaggaactaagcatgagattcaagtcttaagagcctcttgttcccccttttcccccggttaagtacatatgttttgttccttgatacagccttagtagagaaagtagacaatcagctggagaaactctgggcctggcttgggtctgagtttgaattgtagcatcattaaatcttagactctaatttattgtcagaggtaatgttcagtttgctggagaccctcctacacattgatttgtgtgagtcttgccttcctgcttgtttcttacctggcctttgaactggatgtaagcttttgttgactggccctttgaagtcactgcatcttcttttgccagaactttgctgtcagcagtcttccaaaatggatcctgctgtgcacctaagctggccctcctccaatgggacaggtgtgctcagctcatttggataagcacgtggaataccttagttcagatggaaagagtatgcttgttggttgggcagtaccataatcagacccccagatgtacaatttagaatgcagatgtagcaaattgatgaatttagtttgagtggaagaagccgagggatcctaggaaaagcaactgtttttggtaggtcatattgagacacgcttagttgattaaatggtttacacttttctgtgtttgtttacataggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtataggaaaacattaaacctgggtaatttggtataaagcctcaagtgaaaagatctgtttactttatggttgaagataaccaccttgaaaagcttttgtctaaaaagacaaaaagcattgtaatttaattatggggtactggtagtagtgaagtatttctttttagagtaaatcatgttgatggctagaatacttttaaaagatggtattttcctctttaactgccttgtgcctatagaattggcttaaagggttatagattaacttgccactgcattctgcatttaaagccatgctgcccgacattctacacatataaattctccctttcttctctctattgcaagtgtaaactgctttatgtcaacacaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcaggtattatctttgttttttctttatgatatttaataatgtttctacaatctttatttgcagcttcaaaaatggaattaatagtgtgtttagagtccatcaagtgggagggattgccaagaattttcccccccaaaaaaaaagccctgtagtgaggctgtttcctgtgattagttacatgggagcaatttcatgtctccttgtttccacatcctatctccagatgcttcttggatgcggggcattctgtggagttgttcctcttcatgaattcacgtgtttttatgctgccaggttttccttatccaaggattagctgggtagagttcaagaaaacctagtccttgctcagtttctcagagcctgtgctctctgttgcctgaaattcagagaatttttgagctgaaagggaccttagcaggccctagttttatacgggaggaaagcgcgaccctgagagatgaagtgacttgtctaagtcagagtggctcgggctcaaatccacgtgttcccttatgactcaacgaggcaggtgacttaatgtggtttttgctgccgtctcataatgactggggctcaaccaactagattctcccaggtagaggagattataccataatctgggaagatacctatttataagacatttactttagcccttaatgattctttaaaaaaatagactgttgttgttgtaggttatattctcttaaaagcagactcacgtgctttgttccttaacgaatattacttccatttatggattctgagaataataaagcactgcagttggcctaaaactaaacagctaaaactgttcatgaccttaatacactaccagtatgtgaatgaaaaaggggggggccatgttgatttggtatgtttatattcatgcttgactcatttgtatttgaaccaaaaatgagagaaaacaaaatccaaatggtagaatggggagggaggtaaacccacaagtccttttttgtaaaacaaaatattttttgttcctttttcttttcttttgagacaaggtcttgctctgctgcccaggctggagtgcagtggcatgatcacagctcactgtaacctcaaactcttgggctcagatgatcctcctgcctctcctgtgttggcctcctgagtatctaggactataggtgcatgccaccatgcccagctaatttttttctttttttgtagagacagaatcttgctctgttgcccaggctggtctcaaactcctggcctcaaatgatcctctcgcctcggcctcccagagcagtggcattatcagcctgagccactgtacctggccctgttccttttcttaaatttagacatggcaacaccccacctcatagttcttttacattcattgcacttgtagaaaatatttttaaatatacatatgtgcatttatatatgtgctcagaaagcatttatgattatattacagaaagttcaagaaataaagggggggaatcacccatagttctactactctacaacaattttatttgcattttagtctagttatttttctatgtatatttacacatgactgctgtggtatcatattaataattttgcatctttttacatatgtcttaaataattttgtgctattatatctcctactagttcttcatcttaaaagcataaaagcttctgtaagtaccaagtttaagaatgttaccttaagggctgggcacagtagctcatgcctgtaatcccagcactttgggaggctgaggtggaaggatcgcttgagctcaggagtttgaggctgcagtgagccatcatcatgccactgcaccccagcctgggcaatagagtgagactctgtctcaaaaaaaaaaaaaaaagggagcttggattattggattacattctgatggctataagatatacatatataacatataacatacatacttttctttctttcttttttttctttttgagacagggtcacgctctgtcacccaggctggagtgcagtggcgcgattatggctcactgcagccttgaactcctgggctcaagtgattctcctgcatcagcctcctgagtagctgggactacaggcctgcaccaccacacccagctaataaaaattattttgtagagatagaaatcttgctatgttgcccaggctggtctcaaactcatgacctcatgtgatcctccctccttggcctcccagagcactaggattacaggcatgagccaccatacccagccttaagctttttttctatccaacattctactttgaaaatgttcaaacatacagaaaagctgaaagaattctacagtgaacgcctatatactcaccacctaaagtctacaattaacagtttactttcataattacacatctattcatctattgttccaccttattttttggatatttttcagagtaagttgcagatgtcagtacactcccatttagataccttatacatttttgtttacagttcctcttttttcttttgaggtaaaattatatacaatcaaatgcataaaaatctttaactttttaataaaagtaatgatgtggccaggtgcaatggctcatgcctgtaatcccagcatttgtgggaggccggggcaggctaattgcttgagctcaacagttcgagaccagcctaggcaacatgatgaaaccccatctctacaaaaaatacaaaaattagctgggtgtgttgacatgtgcctatagtcccagctacttgggaggctggggtgggaggattgcttgagcctgggagatcgagactgcagtgagccatgtttgtgccactgcactccagcctgggtgacaaagcgagaccctgtctcaaaaataaaaactaaaaaaataaaagtaatgatacccccatatttaataatgaagtgtgttatagttaaaagagaattaaaaaattgtaacacttttaaagaatgctagaaataccagttttgaagagttttattttaatagacctcattagagatactgaacagttaattttataatttgatatgagaaatggaagcttgatctttatcatgtgtcacaaaaatgggcttaaaatggagactgctgcatcttttgaatttataaactatgattttgtgaaatctcataatctgtcaatgggatctggtggcataccagggccatttgaatacctgcccagggcctgcaggatggcttgtgtaatagcctccactgcaaatcctctctgttcaaagacctgaaaaataaataactgagcaaatatatgcatctttgcagtatgataaagcgtcatagtcaacaaaatctttatttcctggtgaatgggttgtggatgaattttgtggtttggatttaattatatgtggactgatccataaaacaaagataatgccctcagtagaattatgttttcaactattaaaataaattagatttttttttctagaaaagagtaaaataatcatagagtgcagagagaagtttatttattggttaacatctagagagtttatctgcttttttttggaaatgctaagatggctaattttgtgcatttatttacttagctttggttgagaattgatatttgttcttccaattgtcagtatggttgaaaacataaggttatcactgtgatttttttagattctagtttgtatctagaacagcagtaggtaaacacttgcttgaatgttcactgcatagttaatgcttctgttaagaaagactgtattctaatgatccactctgtcagaaacttcattatcagaaattacatctgagtcataattatatgtttcagaatgtaagttagggaatcacagtatgaaaatttctactaaggttgttacatatgcaaaacatgaactgttgtatatatgcatctggatgttttggggcagacaaatgcaggtgttagtttaatgttgggcttgagtgagtgagggcttgacccttggctaggccaggaaggaagaggaggagggaggaggtggtactaatatctggagcagaataagctgctgctgatggatcagagactcctttgatctcctgggaagctgatacgagacacctgggacatggggaaggttgtccatcagcattcatggctatcagagttgatggtggactgagtacattggccacatttgtgtctaatcctttatttcccactgaagagacatagaggggtgtctctacccctatcagctcttttcctagtttgaaaggggatgaggtgggggatgggccccagaggacattgggaccctgacactctgaggaaatgggtatcacgcaggcagggaacaatgtgaaaagccataactgagattgaaggaagggaacctagtcacataagtgtacctatgatggacactgttccgctggaggcaaaataagatgcaggtggggatattttttatacccaaacctgccaccttgctgttatatagcatagaaaactaaagttctcccctactttaatttctcatatgcattttaaaatcaaaaattaattgagagaaggttccctttcattcctatttttgaccctagcttctcttggtgtctcttagggggccttgtgtagggattctgttggcagttagagtgcatatgtttttgtcttcctatggaccactgatcagctttgtgacattgggcaggtcacttggctgtaaccttttgggaccaaattaacctgcagttcctcctggctctttgagtctgcttggattggccatgtgttggtgaccattgaagctgagttgacagacacatggaggctcataatgttcatctctgaactttagtatatattagaaattttatactaaaatattaaattcaaattggtctaagttaagcaaaaaataaaaataaaagccaagaaagttaaaaaaaattaaattggcctcaattaaaatgttgaagtctggctgggcatggtggcccacgcctgtaatcccagcactttgggaggctgaggcaggcagatcccttgagctcaggagtttgagactagcctgggaaacatagtgaaactccatctttacaaaaaatacaaaaattagccaggtgtagtggtgcacacttatagtcccaactaatcaggaggccgaagtgggaggttggcttcaggaggcagaggttgcagtgagccgagatcacgccactgccctccagcctgggtgacagagccagaccctgtctcaaaaagaaaataaaaataaaatgttgaagtcttttctctctctcggcagagtcttgctctgtcacccaagctggatgcagtggtgtgatcacggctcactgcagccttgacgtcctgggctctagcgatcctcccaccttagcctctcgagtagctgggactataggcacacgccaccatgcctggctatttttttttttttatttttagtcgagatgaggtcttgctgtgttacccaggctggtcttgaactcctgagctcaagcaatcctcctgcctctgcctccgaaagtgttcagcctcttgagtagctgggattacaggcgtgagccaccgcacttgaccttatcatctctctagctgaaacactcatttcaaattgaccaagtcatttttgattcattatttattcattcagtgggtattttttgagggcctaccctgtgtgagacagtctgttagggtgccctgggactgtagagctgcatacgattaggttcctcctcctttggtttattggagtgcatgtgtgactcagcagaagatgggtggtaccaagctgggagattgaagagaggcatcatgtagttgacatgtgagctaggcttcaaaggctggtgtatgcagacacatggaggcaaaagaaattttatatttacaggttaacaatggcagaaaaacatacacatgaactttgacctgtgtggttttgagcagtcagtgaaaaggaatagagggaaaggagactgaaaggtaagaatgctgcgactgccagcctgatttgacattatcagctgataggagagggctggcagcccagttctggccgccagaggattgctgtctatgaagtagactgaatgcatgttggggctggtgaggcccactagaggacttttgtgcaaaaagtgaggaattaggggaggagcaatctccctgaactttttccatcaactccacagtttctaaattggttcttgggaagacaggagcaaattatatacagtcatgcattgtgcaatgatggggatacgttctgagaaatgtcttgttaggcagttttgccactgtctgaagatcatagagtgtatttacacaaacctagatgatgtaacctactacacacctaggctatatggtagagcctattgcttctaggctacaaacctgcacagcatgttactgtactgaatactgtaggcaattgtaacacatcagtaactattcgtgtatctaaacatatctaaacatagaaaaggtacactagaaatacagtaccaccatcgtttaagtggtcattaatggaaacgccgttatgctgcatgtgactgtaattgggaaagtgctttatatgaactgtaggatgctgtatgaaatgttagttattagttggaagaagacagaaaggaaaactttatatgtgtcgtacggattttgatagaagcttccagagggcaggggaatctgttggttttggttgttgttgggttttttgttgccgttttgccatgcagttcatttctttgatgagtcctaagtgtgtgcaacaggaaattaaggtttaatgtagctttttacattttcttggttattacccacaacgctcagggagaacatcagtggaaatatccttaaacagaaaaataaacggggaaagtgcagtcgagggaacaaaggatcttggaagatttaatgaaactgataccagaaatagtattagaatagaggtttttggctgtattttaattttttaaattgtctaaaatgcatctcaaatgagaacatttgatctttttagcttaactacttgctttgggggtatttcctgaaattattaacttgttaatcaatccatgccacaggaaatagtaaaaagtaaaatgtgaaccaaaagatgattacatttacaaatataaatatttagaacattttgcattctcaagtctaaagagggtttttcttgtaccaaaagtatcataattgtttttaaaagactaaaatttggaggttatactatgttaaatgtatattttctagaaaatgataatttaaattttttattaaagatcttgtagtagaggaactctaggataaattttaatggataacaagtttaaacactaagattttaggaattaaatatataatagcttcaaagtatgtaactcctatggattgaggattgagcatggagtggggacaagagtttcagcagtaatttgtaagaaattataagtaaatgttaataattactcattggaaaactgaacatctttatcagcttatttcctcttgggataaactgaggctgccagaaaaaaaccttatcaactgatttcctcttgtggatggaccatttgtatagttctatttaaatatactattttcctactataaaatgtttttaaaggctattttttcttttgctatggcacaggaattttgtaactttagacccccttaaacagagagcatttgtaattctttgttagtggaggtcgttacggggtgttctaacatttgccagcaaatgtctcttagctagttatcacatacacagtgggaagcttggagcaaattaggaggaaagaagggaaatgggccttctttctaatgaaagtccttctaatgaatcaacgaaaccacagcagtgcggtcaacctgctgcatgattacttttctgtgtttctgccttggcagggagttgaccctggcaacgctggtctgagagcagggagcacggaaagttagatggaagcctttcctctgataagttataaatagacactcaaaaccattttattagaggagctaaaatttttaaagaatatctgtaagcccctcataaccctgcagcagtttggatatatggctgttacatgacttaaataaataagtacatatgtgcatgcgtgcactcatacccccagacacatctgtctgtttgctttctgctttatgatgagctatttattccagtggtgtcctgttatttaaaacatacttcagggctctctttcagatttatcttctgagcctgtaatgtagccattaagaaccccagcagttgcaaatgtcaattctttagacagtgaacttgatttttgagaagagccaaaagcaatttagagttaagtacagaggaatgagataggtacaagctgattagtgccattttgggtccaaaatgagatataaatataaaataatgagaaaattttttcattgatgcatgaggtgcctgcagacaaagcatttctgagtagttttaagcaagtgcagcattcttggaataaggtatagttttccattacaacacttggaagacatgttcatttgaatgctcaatctctgggatgtgaaacaaagcaaccaagacatccattgtctcagggtggtggcacctttccccatagggttattgtaaagatgaaatgagatcatgttggtaagctctaagccccccacatgagggcatgtggtaagccctgaataattgttagctctgtatcataaccattagtttgtaaaagtacttagaggtcaggagagctcttaacaaaagttataagattcagaaggcattaaagtggtaagatagccggggttatataataaatggtagtatttctttaagggtacattgagggtgaacactgtaactggtgttaacaatcataactttgcctaacaactaagactatttcctgagaatttagtgagactttgtaattaagttaatctcttaacagaattttatttcaaaatactattctaagcttcttattattgatacaaagatataaggatttttattaagttagagaggttcttatgtttgatatcagcttttaaagtgtggtagtatttcaagataaaataattttgctggactaacaatgttttggccatttggaagtagaaaataatctaatcgattactttttgcatagtaagtgtctttaataccttgtatttttcaagtaaaaattgtttcacttagaatttgaaggattttattattaaagtggcaaatatttaatgacctctgatttgaaagaactcagagccatgtatctgtagttattttctcctacttgttattgtacatgttttatggcatggaatttagtgccttaattataagaaaagatatacatctttctagttttgtagctatcttaatttttgataaattcttttctccacaaaatagtttcaaatttagttaaacatttgcaaattattctagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaaggttggtatattttgcacatacgttagggataacacaaaagtaatatactattcacgagatacaggtaaacacctgcagtatagtttaatagtaattaatatttcattgtaagctagactgtgaattaggaaatcttttgaagagagtatcaggcattcattcgagcctagttgttctttatatctagttccaataaccttgtgcttcaactgttagtagattggaactttcaagttagaaagggagaggctggctgctgcgaaagaaaaggcatactgagagcagtaagaaacaataactggtaacctaacagggaggaaaaagcaacaaaaaacagataggaaactcaagaaatcaggaagcctaggtcattttatgattcttaaagccccctgagggcattactaggactttgtatcttaaggatgatgctgagtgatcagtgaaagattctagtttgctttggcattctttataactgggagttgcgtaataaatacttttaatggtttgcattaaattgttttgtttttgcttctggcgagtttccattaattggaaaattcagtgatatagaacaactttccccagtgatgctacacaaataaggcagttgtaggtattacaaactggaggccttcaagaatttaaaattttttattttgtgcttcctactagacaattgcattaatctttcttaccttcataaaatatgttttgaaaatgagtttttttcctctgtgtccctcaaactaaggcatgtatttactttaaagcacatagtttgtctgaaacagttcatcctctcagctccagtccctgtcacccaaaggaaatgtgattcttggcagaaatggagctgatttgcagaaaaatccaggagattgtcccagaacagaaacagtaaattagggaagaggattgcttaagtagcattctgatggaccaagtgtattctctttctctgtatcctattaaaagtgtgtagcatagctgatttctaaatgttttcatgaactttaatgtgaattaaagtaaagtggcattagaaggccttctgtgatatgcaaacataacatttagtatttgtttgaaattgttttgatgtttcaggcttgtttttgaagttactttttattttcattcaactgtgaagctctatgccatctttactttccagatatagtaagtcttaccttggagaagaaaggtccttgctttgagagagccattgtcttttcccctggacaagtaagcaggcgtgtcagatagaaagaaaattcttcgattaataaatcaggtgtttttactcttgtttgggcttgggaaggcacgtgagcgctacaaattagtctgtgaaataagtttgggtcccacatatttttaagagaaaacaggttgaattttaaaaaataatcccttctttctgtgcttatatgtaatcttttaagtgaaatcagcttaacattgagataaaactcttcatttcctttttcagcaaattattttccatcacctggcattactttacatgagcgtttctcaacaatgcaagatatacacaaggcagatgtaaatgaaattccattgaattcagatccagaaatacacaggtaatgattgattaccatattatacccatttaactaatggggatatacctcagaaaagatttgggaaggggctgctttccgaacctgctcacttgggcttgctgtagactgtaggattgcatttcctgcacaaaaataataggataatccaagcattatctggccactgcactttgatggaatgaataggatgcgctgaaaacattgactagcgttgtttaaatgtgtaggactttgaagatgcttacatacctaacttcacttctgctgtcaatagtaattgcttcctgaggtcctcagtagaagaatgaaagacagttttcaagccatcgaaatcatatgttgcttcgtgtggtcacaaataggtgttctgagggcagccagatgaaaccacgtgtcttctgctggcacttgttggagcaggtggtgtaccctgtcttgtgagctgatttgaatacatgtgagaatgcagtatatcaccagagcaaagtttgagattacacagactactgatttgagaaccactaaagcttccctatagtgtgttccacaggatatgtatatcctgggagactgccatataggtgaaaaactatctggtagcaagtttcttttgctagctccaaaacatactagctttatttcaaattctgttctgtaatagtagaatcagggtatcagtgtataacataattatttagttgtactatgcctttattattttaggagaatagatatgtctttggccgagcttcagagtaaacaagctgtgatctatgaatcggaacaggttagtgaatacaatttttgatgagaaattatcttattgtttgtatattaacggcaaggggcttggtggttgggagagaaaagggagttaaagtacatgaagaaggaggattgaaacccaggaatctgaaattaaaaaagtcttcaggtgattctgactatcagccaggttggagtgagaatactgacaaaagacaaaaatattccctaagagggacaatccctaaggataacagctttgtaaaattgacacgcaattacagcatttgatattcatccccaaaatccgcactgtaaagcttatggaaagtatgttaggtacctatttttttcaaagcaatcacgtggaatatatttttaaattgtacgtggaatgaatgcacaggaacgaaaaatttcatttgatattgcccttctgtttactgcagaatgtacgaaacattctgtggaatatgaactagcaaaataagggaaataagggactaaatttctttattcatgtgtgtcgttcccacccgacacctcccctcccaccccccatttctttgctaattagaaagactgtcttgactagccaggagggaagaaaactggctcttgttttagaagaattatatcaagttctaaaagaactgctaatttattcattgaggataaagagtctttgtagaggagatattttaatacatttctgatagaatatataaataattttttcacttgtgaaatgattataatttttgctgaacttatggagataggttaatttgttgaacaaatgatattttcagacaatttctaatcatcaaagtcctatactcaacttacaggaaatctgtggttttttaaaaaatcacctataatttagtcatttagcacaaactattatttaatcgtcttttctggcagtcttatagcttgcattttaacgtagtcactatcatagtatatgtagttttgtatgcttttttcttttcacgtgatccataataacattccttttatgtaaaatctctgaattcgctatgaccttttatgactgaggctttttaagttttgttttgagacagagtcctggtctcacccaggctggagtacagtggtgcaattatggctcactgcagcctcgacctcctgggctcaagtgatcctcccacctcagcctcctgagtagctaggactatagacatgcactaccatgcccggctaatttttgtattttttgtggagacagggtttttccatgttgcccaggctggtcttgaacttctggactcaagggatccacccacctcggcctcccaaagtgctgggattataggcatgagccactgcacctggcccttgttaagttttaattaacttttttgtttgtttctttttttttttttttgcgacagagtctcactctgtcaccctggctggagtgcagtggtgcgatctcagctcactgcaacctccacctcccaggttcaagccattctcctgcctcagcctcccaagtagctgggattacaggcgcccatcaccatgcccggctaatttttgtatttttggtggagatggggttttactatgttggccaggctggtcttgaactcctgttcaaatgatctgcccaccttggcctcccaaagtgctggtattacaggcatgagccactgcgcccggcctaattaacttttttcaataagcacttttctatgttgacttccacatagtctttattaccataaattaaatgattgtacattattcttttgacttaagtttaccatgatttatttactcattcttcccttcctcttaattttttttttttacatttaagttgcttctattttttgttattttaaatataatgttttgaatctatttaggtagataaccttttatttgggttagagtcccacaagtgggaatcctggttcaatattaggaacttttctgactgtttattgtcaattgtgtctcaaaatatttgtattagtttacaataccattagcaggatgagtacaaggtaacttatctaggacttgtaattaacgttcttgttagatatggtctttgtgcaactaaaagtaatgtgaatggtttgtcttctgtcaaaattcctcagactctgatcaaaataatagatccaaatgacctacgacatgacattgaaagaaggcgaaaagaacggttacagaatgaagatgagcacatttttcacatagctagtgctgcagagaggtaatcagtagatgacaaacatcctgttatcagggagctttgggttttaccatatttttacattttttgtgtgatgataattttcattttaatatagggatttgctccttcaaatccatcttatatgtttaagtgaaatctattaaaatgtttccaggttattcagtgattctcatatgcggtttgatttaaacaacaaaaactatggggtaggtgaatatttgaggtcttcgtaattctgatgaggagtgttaccacttttagaatattagcaggaggcaggaccagcaagtttacagactatttagcttgagctgattgaaactctgatacattctgccctttagattctgggttagtctttgaatagtagaaaatttcctgaagtcagtacagttatcttttgcgactctttgtggatgtctatactggataattgtggatcactgtactgacaaaaagtgaaaaaaatccacatttttggatgtcgtccatgaaattgaggcaggtgtagtagaaaatgcagaggagacctaagtttgaatctcatctctctcagtttacaagctgaccgatcttggacaaatttgcttagtctctggagcctcttcatctgtaaaatgatgataaaatcaatttatgctatggggcagttatgagtattaaacgagttggcacatgtgaagtacttatgtcatatatggcaaatagatcctcagtagatttttctttcttaacctcatacttctgtttaggggctcttagtagtctagatcaaccccagtttatctctagttctgaacaccatgtggatggaactcacggcaactctggggccccatatgattatgaggtataattgaacaggacaacatttccagttcacttgagttcttatactacttggatctcccaaaaagtgagactgtatgaatacaaagagacagtgctaattgtttttccataatcttttctatcaaattgctaagataatgtatttgacaagacttttaagtcaagtctgtagctaactaggtcagaatatatggacttgatgctgacaataaattcagaactaattaaaacatagtgaaacgatgtgttgaggtatataaaacaattgaaaatgaaagagtaaaaatgttgtcccttgctgggtgaaagtctccagtctcctaatatgatatggttaatgcatgacatgactgtgctccttaatgacacaagctctctatcatgcttttcttgactcaacaagtgtaagaaacccagtaccaagaaacaggattttaaaaacagatttaagacaatcagcatattttaaagatcataagatgctttaggatgtatctttaccccttgacgtgattaagaacttgagcactggagttggacctgagttcagtggctggctcttggattcctagctatgtgactgactttgggaaaattattttgtctctgtttcctcatctgtaaaatagggataagagttgtacttacctcacagtggtggttaagattaagtaaagtgatgagtgtaaggtagagtagctggtcagcattaagtattatgaatgctagctttgaggacagtgtggtagtgtgcaaggatgtgttcctacaagctgtcttttgctgggtctgttggattattttatttgtattggataggtggtgaggcatagtggagccatgaggagtttttaaaaatgagacattacttaacattcatcctgcaaaaataaacaattcagtagtttttagtatattaacaaacttatgcaaccatcattactatctaattccgaaacatttcatcaccccagaagtaaaccctctacccattagctgccactccctgccccatttctccttcccccttagtccctggcaactactgttctattttctgtatctatggatttgtctaatcctgacatttcatataatcatttttcttttctttttttttttttgagacaggatctctctctgtcacccaggatggagtacagaggcacaatcacagctcactgcagcctcaaccttccgtgaggctcaggtgattctcccacctcggcctcccgagcagctgggaccacaggctcctgccaccacacccggctaatttttcgtattttttttttgtagagacggggtttcaccatgttgcccaggctggtctcaaactcttgtgctcaagggatctacccgactcagtctcccaaagtgctgggagtacaggcatgagccaccacaactggcctgacatttcatataaattcaataatataatatgtggcctctcgtaactgacttctttcctatagcataatgcttttaacgctcatccatgttgtagcatgagaattcttatgtatggctgaataatattccattgtatggctatatcgtattctctttatccattcaccagttgatggacatttgggttgtttccactttttgtctgtttgtgaataactgtgctgtgaacatttgtgtgcaagtttttgtgcagatacctgttttcgtttctcttcagtatatagctaggagtggaattgatgagtttgatggttactctatgattaactttttgaggaactgccagactgttttccaaagcggctgtgctattttacatttccaccagcagcatctgaagggtccagttgctccacatcgttgccaactcttcttattaatctctcactttatcctaattcagtttccttatttaaataagaaaaatatattatccttttatcttagaaattcagtttataaaaattgacctcattatatgtttttatataaacttttaaaatcaagtcagggtagtttccacagaaatacgaaagaaatgaaacatgatgcaatcataagtcataggatgtagtgatttctcacctgtgtggctttccttcaaaaagttgtatgcagcctttctgtctgtgtttgctcactgttgtatccccactgccctgagctcagttcatatttgttgaatgaatgaagagttcccaaaggagtagacaagacagaggatacctaacttgtaatacatttagatttgggttactattccctgatgccttaggatctttcacaagcacacctaacacttgggggttctgtctagcctctaggacccatctgttctctacaggtgctccttaacttatgatagggcaacatcccaataacccattgtaaagtaaaaaaaaaaaactgtaagttaaaccattgtaagttggggacggtctggatttacttccacttcttacccgtttcttactctgatgtctccatgttttctcctgacacactatttctgccttttctaactggagttactaagtttcctacaatgtaaatgagttgttttgttatagaggtatggagtgtgtttgataaagtagcttaaaaatagtatcagtggacttgaagaggacatcaaactgccaagaatttcttttattttttatttttattttttaacaaggagttggaacgacagactgtcgttttagctgggcaggttacgggaaaacatcagtttttgttcttgctattgcagtagtcataatctatactgaagtagagtgaactttataaagatatattcatatagtcaacagatatttatgtattgatttctttgttctagttactgttctaaggactggggatatagtgaaaaactatatacaaacctttgtcttcgtgttacttataatttaatagcagaagaaagaaaataaatacatgtcagtggagtgataggtgaaaataaggcagaagaggaaatttaatagcaaagagtgacatgtgtgatatggttttatttagggtgatcatggagtacacttatgacttttaaaaaatgtagctgggttgtgaattaagtgagggtgttagccatagggttatctgaggggatagtatttcaagagagggaacagcaaaagcaaagaccttcagcatgcctgcttttgtttaaggaatagaaagggggacagtggggttgtgacagggtggtaaagggagagagtagatgaggccaatcacgaagggctttgaagaactgaaggacgtgaagactttgtattttattctggatgaagttagaaaacattttgggttctaaccagagaagagacataatctcacttaaattttaaaaggatcactgtggttgctgggtggagagtggactgtaagagctagagaaaaaaagtatttccttctcaagtgaaaaaaaaagattagaggtaggaaatctacatgatagggtcaacacggtagagtggacacatcagggaaccaggctgcttagatcttcttcctcccatatcctctgtatgtagcatctgtctcatgatccaagatgggtatttgtgccctagccatcatgtcctcatactagcctttcctttaaagacttcttgaggagccaagatggccgaatgggaacagccccggtctacagctcccagcgtgagcgacgcagaagacgggtgatttctgcatttccatctgaggtaccgggttcatctcactagggagtgccagacagtgggcgcaggccagtgggtgcgcgcaccgggcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcatcacgagactatatcccacacctggctcggagggtcctacgcccacggaatctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgacccctgacccccgagcagcctaactgagaggcaccccccagcaggggcacactgacacctcacacggcagggtattccaacagacctgcagctgagggtgctgtctgttagaaggaaaactaacaaacagaaaggacatccacaccgaaaacccacctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaaattgaaaactttgaaaaaaaattagaagatgtataactagaataaccaatacagagaactgcttaaaggagctgatggagctgaaaaccaaggcttgagaactacgtgaagaatgcagaagcctcaggagccgatgcgatcaactggaagaaagggtatcagcaatggaagatgaaatgaatgaaatgaagcgtgaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaatgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaaccctacaaaccagaagagagtgggggccaatattcaacattcttaaagaaaagaattttccacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacacaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggcgctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactctctctcagaccacagtgcaatcaaactagaactcaggattaagaatctcactcaaagccgctcaactacgtggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaagatccaaaattgacaccctaacaccacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattgggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacatacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatggccaagtcaatcctaagctaaaagaacaaagctggaggcatcacactacctgacttcaaactatactacaaggctacagtaaccaaaacagcatggtactggtaccaaaacagagatacagatcaatggaacagaacagagccctcagaaataacgccacatatctacaactatctgatctttgacaaacccgagaaaaacaagcaatggggaaaggattccctatttaataaatggtgctgggaaaactggctagccatatggagaaagctgaaactggatcccttccttataccttatacaaaaatcaattcaagatggattaaagatttaaacgttagacctaaaaccataaaaaccctagaagataacctaggcattaccattcaggacataggcatgggcaaggactttatgtccaaaacaccaaaagcaatggcaacaaaagccaaaattgacaaatgggatctaattaaactaaagagcttctgcacagcaaaagaaactaccatcagagtgaacaggcaacctacaacatgggagaaagttttcgcaacctactcatctgacaaagggctaatatccagaatctacaatgaactcaaacaaatttacaagaaaaaaacaaacaaccccatcaaaaagtgggcaaaggacatgaatagacacttctcaaaagaagacatttatgcagccaaaaaacacatgaaaaaatgctcatcatcactggccatcagagaaatgcaaatcaaaaccactatgagatatcatatcacaccagttagaatggcaatcattaaaaagtcaggaaacaacaggtgctggagaggatgtggagaaataggaacacttttacactgttggtgggactgtaaactagttcaaccatagtggaagtcagtgtggcaattcctcagggatctagaactagaaataccatttgacccagccaacccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgttctttgtagggacatggatgaaattggaaatcatcattctcagtaaattatcgcaagaacaaaaaaccaaacaccgcatattctcactcataggtgggaattgaacaatgagatcacatggacacatgaaggggaatatcacactctggggtctgtggtggggttaggggagggatagcattgggagatatacctaatgctagatgatgagttagtgggtgcagcgcaccagcatggcacatgtatacatatgtaactaacctgcacaatgtgcacatgtaccctaaaacttaaagtataataaaaaaaaaaaaataaataaataaataaaaaataaagacttcttgaaatttacacatgataacttggccaaaatttagtcccatggccatgcctagctgcagggcagctgggaaatagattctttaatctgagcattcatttgcctggtcaaaaatcaaatatcaaaggatttaatttttgtattgtggcaaaatatacatatcctaaatttaccattttaaccatttttaagtgtaaaattcattgacattgagtatattcacagtgttgtacaatcaccaccactatctacttccagaactttttcatcttcacaaacagaaagtctgtttccattgaacagtaactcctcatgctctcctctctgcagcccctggtaacctctattctttctgtctatatgaatttgcctattgtgggtatctgatataagtagaatcagacaatatttgtcgttttgtctctggcttatttcacttagcatagtgttttcagggtcaattcatgttgtatcatgtgtcagaatttcattccttttttaaaaaattcattctcttttaaggctgaataatattccattgtatggctgtactacattttgtttatctgtttttctgtggacatttgtattgctttcaccctttggctattgtaaatagtgatgttatgcatattggtattgtcatctttttggttatagccatcctagttagtgtaaagtggtgtctcattgtggttttgatttgcatttctctaatgactaatgatgttgagcatctttctatgtgcttattggccattggtatgtctttggagaaatttctattcaaatcctttgcccattttaaaatcaaagtatttttgttgttgaggtgtaggagttctttatatattctggatacagctccctcatcagatatatgctttgcaaagagaattttaaaaaatccattgctttgtttgtagaagtagtcatacacactaatggtaatcatttggaaaaatataataaagtataaaatcaaaaatataaggcattcctaattttaccagtcagagatgaccactgttaatatttagtacatttcttgtcatttattttttctgggcacatatgtgtatattttaaataattgaaattatcctcaatatacaactttgcactttactcttttgatctactgtcgtgagcattttgacaaagcataggcctttttaacatttaaaaaaccccgagtgtctatttcatgtcagattctgggatcagagctggggccacaaaacgaatcatccacattgcttcctctgaaggaatagcaacttgttccgttaaacagacaggtacaccagtagttacaaatacggaatgataggtgttaagacctaaaaatgctacatgggcacatagcagggagtacctagttcacctcagaagggtttaggaaactcttccttgaagaggtacaaatggatctaaatctttaagttaatctaagtagaaggaaatggtcacagaaggaactgcacatgcaaaggtgtagaagcaggagagattgctttgtgccaggaaccacatgtacttcaatattcctggctgggcacggtggctcacgcctataatcccagcactttgggaggccaaggtggatggattacttgaggtcaggagttcaagaccaggctggccaacatggtgaaaccccgtgtctactaaaaatagaaaaaattagcggggtgtgatggcgtgcacctgtaatcccagctactcggaaggctgaggcaggagaatcagttgaactcaggaggtgcaggttgcaatgagccgagattgtgccactgcactccagcctgggcaacacagcaagactctgtctcaaaaacaagcaaacaaaaaatcctgaagctcagtgtgcctgttggggagattggagcgaggtagcaagggccagagcagaaagggctttggggggtcacgatgaggagtgtggaagttatcttgttgccagtggggaatccatgggaaagagtgaaggtgggcctgcagaagacacaggaaggggctgagaagcattgtagagagatgcaggatgtgacacggagaggaatccccaagggctgtggaaatgaggctttggagatcagaggaagatcccagggaaggacctccctcccagatagggctgcctgagaagagccctttgtggcctcagtacctcatgatgacgggagagaggaggctgtccttcgctgctgtggtcctacagtatcagaggcctcagctctgccagtgaggggaccctgagccagtcatacaccttgcctctgttgaatgggctgggtcatgagccattggtgcttccaccagtaagagctgtcagcaagaaggggaggggggcagtgctgccaaaggttctagagcagtaattatctttcctcaaaacacacatttcacatatggtttcagggggttacagcccccagaaagcctgtccttagaccccagattgagaacctggttcaaggagtgtttttccgcattgctaacctccaacttagataaataacatttgttggaaaatgaggggtttagccctaatgactatcatttgtaattttagtagtgatagatcattgagatttcacttgtgtgctactttaattgtttctgaaggggctttttaaaattattcttgtttatttcttggaaaaaaaggtatactaataaaatattcttattttctctgtttccttattagggatgatcagaattccagtttttcaaaggtaaagaatgttcatactgatggattccaaaaacccacacattttataaaatcaaattttagaaaatgtattgaaaaaccttacatggtaagattgcagttccaaaatttgcatttttataatttcttcttctccaatacatcaaaatgtgcagggatcaccaatatttttcacgtttgtaattgttcattaagtatatgttataagattccgttgatgcttaaagttattatgacagaagaaatggtcatttcttacttgatttagtaggattttattggattcattaaataaagctaataaatctagctttcttaagattttttggggggccaggtgcagtggctcatgcttgtaatcctagcactttgggaggccaaggcaggaggattgcttgagcccaggagttcaagacctgcctgggcaacgtggctagacctcatctctacaaaaaaatataataataataaaagaaaaaaattcaaaaaagattttttgggaacaacacttaagatctcttggaacatatttattaaggcataattcacataccataaaattcacccattttaggtgtacaatttaatgatttttagtaaattaaccaaagtgtgcaaccatcaccacagtccagttttagaatattttcattacccaatatgaaccctcatgcctgtttcgttactcccctttgccacccccaaccaacactaatctactttctgtcttaaagatttgcctttttatagggcagctcacaaaatggcagctagttccataagaacaggcaagtaatggcgagaaagatggaagccagagtcggtaacctaatttcacaagtaaaatctcatcctttaccatattctttttgcaagaagcaagttcctaggccctgccgacactcgaagggaggaataattggtcggatcactgggagccatgtcagcagttgcctagtacagtcctccctctggccagactctgcagaaagtggaaataatagaaggtgataagactgttgattttagaaaaaggaaaccatcttgagaatgggccccatcttttctgtctccaccagaggatttaggttcttcatagttacagacttactaatgtagttctttcttttatttctggtacttttctagccatggcaagagcatcacctcagatcagttacctgagtcaggaaaacctgcctcctgcaatgttgaggatttgtattcttcttaggcagtaggaacccttcagcaactcctgatagtaatgggtttatttctctcctagctgcctgaataaatgctagatgtatcatccattttctcagattcacccattatgttatacacgagtatgttttatacttgttacaggcgtaaatgatcctggctcctcacaaactagcatggatcatgttagtcaaagtcgagggtcaagttagcatgggtcaaggaggagatgtgtatgtgctctacagctaagctccctgctccctgctttgtgttcttaatcctgtacatttaaaatgtgttttctaatggtaaaacaagcttttaaagtaaactttaaagtctgttaacccacactactactttttttcgtgcagaattatactacgcagagaaaagacataattactcacaaaccatttgaggttgagggaaaccaccgaaacacaagagtaagaccttttaaggtattgagtgttgttttccatttaattccagctttggttttatgctttggacacaatgttttaagtgttagtaaatcaagagctgttttgtaatatgctttcaaatggtagctataaactagtatttctggacatttatagttaactgtaaccaatttgttgatgacccctttccttaggacttgattttcaatttttttttttttaccagtagattccttttccaaatattacatggaaacacaaatacataaaacagatgcaggtggagtgactctaggtggggagacaggcaaggctgcagaccctccctttaagccagcacctttacctctaagatacacgtgcagagctgtagagctttctccaagattcacagattgaaaaaccctgccatggacacacaacccttagaggcgttctggatcatcacaggaagattctggtccaggtagctttgttaaagcatattttatcacactctaattattggtacatctatatctgatatgaatgataatttttaatcaaccaatatgtttgattatccagaacacctcatcccccaaatatatggagtaagaattatagtacaaggtattatatttcatttttttttttttttgagatggagtctccctctgtcgcccaggctggagtgcagtggtgccatcctggctcactgtaacctccgcctcccaggttcaagctattctcctgcctcagcctcccaagtagctgggattacaggcgtgtgccaccatgcccagctaatttttgtatttttagtagagacagggtttcatcatgttggccaggctggtctcaaatgcctgacctcaaggatcacccacgttggccttccaaagtgctgggattacaggcttgagccactgcacctggcccaaggtattatatttctgtctccttgctcacaaaagttgaggtgtttttaaaatcaattttgacagtttcttgcctgtaatagatactttattaatatttttcactcatattgtctccctcccctaaataaaggaaagaatgtgagctttttgtgtaaaagtggcaggcaggcttgttagagtagttagctcattaggaggaagttagtatgaacagaaaagtagtagaaactatctaaaattatggactagaaggttaattgagtgatctattaatattggcttcttgagagtcagaatttatagatgtcgaaagattttattcaatgagagtaacataatttgtaggcattgaatagattacatttttagccaatggtttatgtacctaaaattacatgtgtgacacgaagtttttaaaaataattacggccgtagaatatatacatgttttataccatcttttgatctcttgagtaatggggcatcacatcaactgaaaatgtgatgtctgcataacttacagacaacatagatgggctttcagatttaagtgcttcctacatgttgttctcattggtcagatatagttgattatagtatttttctaacagcatcataagatttattttctgttaccttttttccttaagggaagatactttaacataaattcatagaaaaatgttttcaagatatatgtaataactttacctcttgaccaatcatttaaagttatataatattacatgaatgcttagaagtgtacaattctttgtagtaaaatagtgggcagaaataatccttcctaagaaaaggaaatcttttggctgggtactgtagctcacgcctgtaatcctaacactttgggttgctgagacgggtggatcacttgaggtcaggagttcgagaagagcctgggcaacatggcaaaaccccgtctctacaaaaaatacaaaaattagctgggcatggtggcgtgcacctgtactgtagtcccagctactcaggaggctgaggtgggaagatcgcttcagcctgggaggcagaggttgcagtgagccaagattgtgccacggccctcaagcctgggcgacacagtgaagagaccctgtcccaaaagaagaaaaaaaaaggaaatattttgctaaaatttactttttacatgaattggactagttcaaagcgacatagtaataaccttagaggacatgtagaaatggaacacatcagtctcaagattagctctgatgtatcaagtttgtgcagatagtcttaacattagtgtctcattataattctgttttacctgaaattttctgtagccttaagaaaataattgaaaaataggcctggcataaattttttttgtaaaattatgtgcttcattatgtctgacatatccacttctgaaataattgtgaaaagaagaatctgcttagttttgttaactattccgttgtaatacatcatttgcgcatttgttttcccaatatggctcatgatctgtttcctgttattaagtactctgaggatggaacttaagtcaaccaaacactaaatttcaaaaagaataaaatctatttctgtgggcaagtctttgacaattattacagaacctaaacattgtacttgttctatttagatgtctatatattaggacatacttttaaagccatagttctgtctagcatacatttcggctttcactaaattagtagcttaatatttttgatgttatgggtcttgctacagccagttcttccctttcacaacttcataactgtcttcttgttaaaaagcaacagcagctccagcaacaccctacctgtctaagactcaatctcttttcctcctggcattgctttagttgctggttaatctgaactttattatcaaagaggaaacaaatagtgtttaaagagggttgttatttaatgcagccattgtagtgtttgtaaacaattttattgacttctttagaggttaatagtgtattcaaccttataatagtttatttaggagttattattgtttagctcttcatgttgagaaaatcttgactcatatccggccaggcatggtggctcacgcctgtaatcccaacactttgggaggctgaggcgggcagatcacttgaggtcaggagttcgagaccagcctggccaacatagtgaaaccctgtctctactaaaaatacaaaaattagctgggcgtgatggcatgtacctgtagtcccagctactctggaggctgaggcaggagaatcgcttgaactcaggaggcggagattgcagtgagcccagattgcactactgtacttcagcctgggtgacagagtggaactctatctcaaaaaaaaaaaaaaaaaaaaaaaatcttgacttgtatctgtaaagatgtataaatatttattcagatcctaactttctataaacgaaatgtgcttttgtttgcttttgtaattttagcttctgttttcagccttaatcatttacaaatagtaaactctttccctgaaacattctaaaaggggccactattagtttcatcccatttgattggaccccggtcatgtagtagttggaatgtgactcagggatgttttttatgaaaagcaaagaaagaatttgatttaaagacaaaactcttcccatgtaactttgtgatgaaacatttacatgtaactaggttgtcttttcctttttacttgagaaaattgagaagatgagaacaaatttgcagataataaagtttatatatcaatcttctgagtaaaattctcattttattaaaaaaaagaacacacatttgggaataaatttagtatgcactggctgctattttaaaggtatagaattcatagctttcattctgacccttgtacctgcctgataaatgaacactggttgagttcttagctcttgagtggtaaggcaaatggaagaataagacttcctgcttgtgccattcaaactaaatgctcttttgtgcttttcaagcgtggagagcctttttcctggatcttggtagactcctattggcaaaatcaggagtagctatgtctccagtgctcagacgcagcatctctactaattgtcagcccctaaaggaaaagaggtggatctgtttagtctttgtaccttgcatataatgttaggtatgaattttgttaaataagttcagaacagttttatagtttactatgcctgagagaggacgctgggtcaccaaagtctttccttctctaccatatctctctctacttcttggaattagatcttccaatattcaagttatgctgaactggtcttgttaaaagtttcgttcagcccagggtttttcttcatatggcttcatgtttattttctataggagaatttaattgaatgattttgggggagaaatccttttcatagtcaagagcttaatgcagcttcttccagtaagttggcaagtagctaagtttttaagatttatcagggcagagatagactccatctatgaacctttgcaccactgctcccatctgttttagattattctaggaggatgcttggaaatgcaggcagacacaagcagtgtgtgatatgggggagtgagggagggagacttggagaattgtttgggaagatttggagaggattggttcacgactgacaaaactgaggactgttttcctcttccacctccagcagtagattaacaagggaccatttctcttatcaaccacatgggaaacacacaaatattcgttgtcctcttatgtctaatgtaatgctggacagtatatgcagcctaggaagtgttctttttaagtaatggatcttttgtggtaaagaaagatttgtttgaaggtattaacaggaataaagttaaaagagtttttgattcttaaatagatattgatacttaatatctttccccctcattggggtttgatacatttcactatgaatcagaagaataattttagttcattagaggttctgaacattttattttgttagcatgatgaatttcaataattaatttcaaattcttttctttttttattttttgtagagacagggtctcactctgttgcccaggctggtcttgaactcctggcctcaagcagtcctcccacctcagtctcccaaagtgctgggatttaggtgtgagccactgtgcccgccctcaaattcttttaacttaacagttttaaaaatttggtttgatgtagttttgttttgtttttttgagacagggtctcgctctgtcacccagactggagtgtggtgtcacaatcacagcttactgcagcctctacctccaagactcaagctatctcccacctcagcctcctgagtagctgggactacaggcatgagccaccatgcccagctaagaataaaaattaaaaatatatatattgatatataaaatgagctaggaagccagcttgagagaaacctactttctcaccatcattgactctttctgttttaacatctataaggcctagaatccaggacagctccaagtaccagacagtttttcatctgtttttttgttttgttttgtttgagacagggtctcactctgtcacccaggctggagcgcagtggcactcttttgtacttttcaagcatagagaacagtgactcgctgcaacgtccgcctcccaggttcaagcaattctcctgccttagcctcctgagtagctgggattacaggcgcctgccaccacgcctggctaatttttgtatttttagtagagacggggtttcaccatgttggccaggctggtctcgaactcctgacctcaagcgatcagcttgaggagttctgcctcagtctcccaaagtgctgggattacaggcgtgagctactgcacccaaccacccactcatctgtttactaataaagtagacttggaaggtgtagttttagcatttaattccttttttttccttcacagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatttaaaaatgtttagtgacttttaaactcctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggaaactcaggtaaaggcttttaattgatgtattttaatcttatacaaagtgaattatctgaatgccaaaaatatattgaatatatacaaagggtgcataattgcaaaatacactaactcttttccccattcatatatttttttgttgtggtaaaatatgtataatataaaatttgccattttaaccatttttaagtagcatcaagtacatacagttcagcgacactaatttcattcacagtgctatgcaatcatcaccattatatgttcttttgcaatttatgtttttaattgacaagtaaaaattatatatatttatggtgttcaacatgatgttttgatgtatgtatacattgtggaatggctaaatcaagctatttaaaatacccattacctcacatacttatttttttgtattgagaacacttaaaatctactctgttagcaattttcaggtgtacaatatattgtaattaactgtagtcaccatgatgtataatacatcttttgaacgtattcctcctgtgtgactgaaattttgtgttgatgctttgaccaacttcttctcaatccctccagcctctggtaaccaccattttactctgtttctgtaagtttgactttttttttagatgccacgtgtaggtgagattatgtggtatttgtctttgtgtacctggcttatttcacttaacataatatccttcagattaatccatgttgtcataaatgacaggatttccttctttttaaggctgaatggtattccattgtatatatatgcattttctttatccattcagccgttgatactgaggttgattccattatgctaatgcttaatgtttttattcctaactccccaaacttgttaataactcttttttaaattttttaagtttttaattttttgagacagagttttgctcttattccccaggctggagtacaatggcacgatctcagctcagtgcaacctccgcctcctgggttcaagtgattctcctgcctcagcctgccaagtagctggtattacaggcgcctgccactacgcctggctaatttttgtatttttagtagagacggggtttgtccatgtaggccaggctggtctcgagctcctgacctcagatgatccaccctcctcggcctcccaaagtgctgggaatacaggcgtgagctaccacgcctggccgataactcttaatgttaataaaaagtttctttacttggtaattggaattgcatactcttttagttgtagattgattttgtttgaattaaccatgttagtatttgaaaattcagcataaggccaggagtggtggctcatgcctgtagtcccagcactttgggaggctgaggagagaggatcgcttgagcccaggagttcgagaccagcctgggcaacatagcaagaccccacctctacaaaaaagttttttaaaaataataaactgggcatggtggtatgtgcctgtagtcccagctacttggaaggctgaggtggaaggaccacttgagcctaggaggtcagggctgcagtgagccatgatcatgcaactgcactccagcctgggtgacagagtgagacctattaaaaaaaaaaagaaagaaagaaagagaaaatgcagcataaatatgccataaaattaacttctacaaaataattatattttaaatgagaattgctgggcatagtggtacatgcctgtagtcccagctacttgggaggctgagatgggaggattgcttgagcccaggagttcaatgccagcctgggcaacatagcaagacccccaactattaaaaaaaaaaagaacaggaagagaaaaaaacgaaatgagaacagtagcattatatcagtaagtgaggcatgtttgtcaattcgtaggctcattttagttcatgattttaggctaatattttcttctgagaaatgtgtgtatctctggtattgctattgaatagcccaactgtggttttataacttttataatcataaatgttttcttaaatacttacacttatgaagcctttacactgagcttgcttaatgattttagtaaatcttaacacttttcaaaagacggatgagtagaatgaagttggcaacttattttttttatgttttagagttaaatagaatatcttatgtcacacatacaaccccagttttaactgagtaccttagaagatttctaatttcaccatgtgtgtcactcatggttttaggaaagccatctctttatttatttatttatttttgagatggagtttcattcttgttgcccaggctggagtacaatggcaccatctcggctcactgcaacctccgcctcccgggttccagtgattctcctgcctcagtctcctgagtagctgggattataggcacctgccaccacgcccagctaatttttgtatttttagtagaggtgaggtttcaccatgttggccaggttggtctcgaactcctgacctcatgtgatccacctgcctcggcctcccaaagtgctggcattacaggtgtaagccaccgcacccggccgcatctctttttttaaaaagtgtcaatggaatcattttcccgtctcgtatatctccccaccatcaggctgtgccaggacttaggtagagatgctgcttctcttcctgccttgtgtggcaagtttctttgcagcagacctttcagatatttgttcccagtcacagatggcagcctgactgttttcagggaagctagtcattgattttcactcaaggaaaatggctgaggcaggccttctcttcattcgcaaggttgggtttctggtacatggtgtcttctgtttgtcttctgttagctctgtgctaaacttggagttttagcttaactctatttttgctccatcttttccagtgacttggggctgctgaatgcttacctgactgtctgcttcagcttatagtttctatatatcttggatcttgctccatttttttattcttttgtttgcctcagtttgcccaattcctgctgaccaccctattcttccagactacattgctcaccagccccgcttcacagcaaatagaaatcagaaatcaggccttcatcataggacataagaagtatatcctagaagaagctacagcctgctacgggtctccaatctttaggcctaggctttttgcatcatctaaagtgtagcagttatagttaggtttcagtgctggtcaccacctcaccttcctgttgcccttcactgccatctggctgcattagcagtgtctcaacacactggatttttttttaaattagtgtctactattcttgcagtgtctactacctgtttttcttaggcccacccttctggatgctgcttcatatatctttctattgcagccactttgacatggagttttccaatctggctactgtcagtgcctgcaagcaagccagagccacaatttttatagatttgtgtttgaacaaagcccagctctacaagtacagcatcaactcaggtaccttactactagcaccctactgaacagctgggctccactctcctaacctttagagaaaggaatgaggcattgaagctgttctgtttgtgccagggtctgaagtaagatacctgagactaacttggcctttcagctgtcccagtcataacaaatcccattccatgtgtataaactgatggcttagacctattagtccattttatctcaggccttcgtgccttcaaaaaaagagtgaaggcctggagactctggtttcttccagtgttgctttccgtttcccttaaatgagggacatttttgctcaagtagggttcctgggtgaggtaccatttatatgactcttcatcccaagctttagcatcagagggaactttgaaggttcttccttagagagaaatcttagtctgaacagcatccctgcactgctttggctttttgccctcctggagaattcgttcttttggcagttattagaccaccacctagactcattaaggatgcatcattaatctaaatgccctggaaccttcttgagcctgaaattgaatatgaacctatttattcccatatgccttaaagtccaccaagaatatttagacagatcttatctggactcctcactcccctgccatattgaaatgctggagtgatcactcatggctgggaggtcttgcatttcctcatctgtagtacagtctggtgattatgctatcctatgccatgcacttcctgcctccaacaaaaaacagctttggggagtggtggcggtggtggggatcctagatgtgctcctaatacatcctctgcttccacttaccagaatgatagtggcttccctaaaactgcattggctctccagctgcctacaaagtagtcagattcccaagcagtagtagaaaagtacagaacggaaattcttcctcattcatcatgtacttgtcatattccattgtggcaccctaagtcccttttactgtgtttattttctcttggattctgtgcttgggctggaagataaaggggtgggaggaatgtctgttactacctggaataaggcttgtctttaatccactagcattcagaagtacccccaggaagcatcctctgctcaccatagaaagttttcagaaactcctgagagtctgattatatactagattggaacaaagaagctagtaagaattaatgaagtcacctctgggaacattgcctctgaaaaactgtaagtaattgcgcatttggccaggaaggcaaggaattccaaggcagcggagatctgaggagcattctccagcagtcctcaggtgctgtggtgcttaccagagctctgtccagggataggaaaggaagagagaagagggcataatgacagtgcagaaaggaagttagagactgggattcgtggttttgggggttgaaagaaaccttgaaagtcatggagtacgaaaatagaacaggaaccaagattagctgaatcaacagaaatctagtatacacttgccaggtcccttgagctgaagtgtgccagggtgcaaaggaagtgttgcataagggcatcatcactttcaagcacttaggatctggaggctccagtttcactacctacctctctgccttctctgtcttatttggttttctcttcctccatgcattcttttaaaatgtaagcatttcctagtgtgatgtgatattattctcttttttcagtcctccttcttgtcttgattgcccttacctcctcccaagatttcagccatcacctctgttgatgtcttcaaccctgactactctccagacctccagattgtcagctgcctcccagatgccctcacatggatgtcctaaaagcacctcaaatttagcatgtttaaaatcaaacttgcagctgggtgcggtggctcacgcctgtaatcccagcgctttgggaggccgaggcaggcggatcacctgagctcaggagttcgagaccagcctggccaacatggtgaaaccctatctctacaatcccagcttctcaggaggctgaggcatgagatttgcttgaacccaggaggtggaggtagcagtgagacgagatcacatcacaggactccagcctgggtgacagagtgagattctgtctcaaaaaaaaaaaaaataaataaataaataatcaaacttgcattgaaacatgctacagcatgaaagacccttaaaaatatgatgctaagtgacagaagccagacacaaaagaccacatattgtatgattcagtttatatgaaacgtccaaaatgggcaaatctgtagggacataaagtaaattagtggttgccagtgactcggggatgaggggaaaattgagagcaggtatgggttattgctaatgggtatgggatttctttttaggggaagaaaaatattctaaagctgattgtggtgattgatggttgcacaactctgtgaatatactaaaaagctactgaattatacacttgaaatgggtgaactgtatagtctatggattacatctcagtaaagctgttaaaaattatgtcagacttgctgtcctcccccaaccacttgttttccctcaggtcccctagctctcaaagctagacaagccaagctggaaacgtgtcctactaattctcccagttctctttccaactttaatggtttcaagtcttctcatttccatcactcattcattactacatttgtttcatccattttaatggctgcatattattccactctgtggatatatgaattatttcagtggtcttcaacctttttgctccatactgtaaagttttgaaaagttatctaccttcttgcacattggtaggttatctaatatttttatcgtaaattattgtataggatacaatttctggcatattataaacactgacagtcttaaaactgttgcattatatttttaaatctctttggaggaacctacataccacaggaactcgataactaataccatcaattttttttaatacacaaattcttttaacagtgagaaattttgcattgttcctttttttgccttgaatttggacttcattccactttctccatataattttttttttttgagatggagtctctgtcacccaggctggagtgcagtggcgcgatctcggcttactgcaacctccacctcctgggttcaagcaattctcctgcttcagcctcccaagtagctggtacaacaggcgcatgccacaatgcccggctaagtttttatattttttggtagagatggggtttcaccatgttggccaggctggtcttgaacccctgacctcaagtgatctgcccacctcagcctcccaaagtgctgggattacaggcatgagccactgcacctggcccctccatagaattttatctttaaaagtattttgttgatcaccaaatctatttggtgcataatgttattagatttctgtgactattaagtgttaaatatttcctctggattgagttaatattacagttgaagtattgatgaaacaaaagaagtcttactgcaaatgcatttttttaattagtttatgtattcatatatactgttgctagtagaataatatagtattcaagtattctattttttttctttttatagatataagtgctgagaaaccctatttatatgattacatagatgggaatgaagggacttctatttataggaatgccactcagttctctggactcactctgaattttaggccaaacaaatcatgtactaatctattatcaaaaagtattttgaatgttctatcactgatagcttgattttgtccaggtctcgaactcctgacctcaggtgattcgcccacctcagcctccaaagggctaggattacaggtgtgagccaccattcccggcctatggttaacttttaaacatattaatatttaatccatttagaatttattttattattcattttattatttttattatttatttatttattctgagacggagttttgctctgttgcccaggctggagtgtaatggcatgatctcggctcactgcaacctccacctcccagattcaagtgattctcctgcttcagcctcctgagtagctgggattacaggcacccactaccatgcccagctaatttttttgtttttagtagaggtgggatttcaccatgttggccaggctggtctcgaactcctgacctcaggtgatctgcctgtcttgacctcccaaagttctgggatttattaggcatgagctaccacgcctggccaattttttatttttttgaggtggagtctcactctggcgtccaggctggagtgcagtggcatgacctcagctcactgcagcctccgcctcccgagttcaagcgatcctcctatctcagcctcccgagtagctgggactacaggcatgcgccaccctcctggctaatttttgtatttttggtggagacagggtttcaccatgttggccaggctggtcttgaactcctgacatcaagtgatctgcctgccttggcctctagaatttattttatttttatgatatagtgtaaagtcaggatctaacttttttccccaataaatagttttttaacactgtttattgaaaatttgtcctttccctgctaattgaaaatgctgcttttactatattctgcattcttatgtatccctgatctgtttttggaagctttggagtcttctcgcttgtttcattgcttcttgtgatattctaatttagtctctttgatcacagtcattgtcctgaaacacagatcatatcatacccctcttgcacaaacaccttccaagtattttattgcctacaagaaaagagaccaaacttgttagccaggtctaaccctaagctatcttactagctgcatttccccatagactctctgctttttggagcatactgtattttcatgtatttgtacctttgttcctactgttctcttagctagaaatagcctcctgagccccattcttttcttattaaaccctactttccttttaggacccactgtaaatcatatcaaagcccccactataacttgtgtttcatttagtctctaattattgtcatttgcctttgtatttccccaaatagattatcaaattcttgagggtgcctcgctaagcattttttttttttttttttagacagggtctcactctgtcgcccaggctggaatgcaatggtgtgatcacagctcactgcagcctccacctcccgggcttaagtgatcctcccacctcagcctcccaagtagctgggactacagatgtgtgccaccacatccggctaatttttgtattttcttgtaggtacggggtctcgccatgttggccaggctggtctcgaactcctgggctcaagcgatccacccacctcggcctcccaaagtgctgggactacaggtgtgagccactgcacctggcctcgttagtcttttatcttaccttattacctttcatatagtcagtcttcagaaaatgcttattgaatggagttgaatttattcatgcacacacacacacacatccatccatatgctctaaaatgttagtgaacaaaagccattgtgtcaggggtccctaagaccatccccaggttttgctaggactcagacgacttagcatatagtctttctcataaaagaatagagagcaaaatcagcaaaaggaaaaggcatatagggcgaagtccagaggaaaccaggtgcaagtttccaagggttctctcccagtggagtctcacagaacatacttaatttcctcatcaatgagttgtgacaacacatgcgatacattaccaccctgggaagtttgctagagtctcagtaccaagagtttctactgggggctgatcatgtaggcgtcccctgccaagcacatacccaaattccagactgccaggaggaaagggagtgctcagcgtaaaccatcttatttacacaaacagtttcagcacccatcagttaatggtggggaccctcttgaaatctaagttcccagatgctggccaagggccattttgtaagcaggcctttccaaggacagcagtcagatctgctgtgttaacccttttctgtacaacctttttttttttttttttttttttgagacgaagtctcactctgtcatccaggctggagtgcagtggcgccatctcagctcactgcaacctccgcctcccaggctcaagcgattctcctgtcttagcctcctgagtagctgggattacaggtatgcaccactacacccagctaatttttgtatttttggtagaaatacggtttcaccatgttgtccgggctggtctcaaactcctggcctcaagtgatccgcccacctcagcctcccaaagtgctgggattacaggtgtgagccaccacacctggccaacgcaaccatatttttgttttgtttttgaatggagtttcactgttattgcccaggctggagtgcaatggcacgatctcagctcactgcaacctccgcctcccaggttcaagtgattctcctgcctcagcctcccaagtagctgggattacagacacccactatgacgctcagctaatttttttgtatttttagtagaggcggggtttcaccatgttggccaggctggttgcaaacaatcatattttttaagagcttaacttcacagatggttaatgcctaaagggaagagaaaatcaatatggtaggaatggtcaggagatacatgctaagtacttccattgatacactcttcttacaggaggtagattataagctgaggcctggagaagagcaagacatagaaagggctaaagccaaagacccatgtttggcaggaggatgtgaggttggggagaaatggaggtgtgcaaattatagatggccccaaaagctgggcaggaggatatttagggtttgatgtggtggcactagaacatcttcctagactgaggagaaagtggtactttaggatggctatgtagttagcagtgggtggggaggttctggggagaagaaatgaggtgcaggaagaccaacaagggaacgtgtggtgacccagatgacatgttatgaaaacctagataagaagtgctcatatatctagttcagcattctgcttaaaatgggcttttatggccaggtgcagtggctcacacctgtaatcccagcattttgggaggctgtggtgggtggatcacttgaggccaggattcaagaccagcctgggcaacatggtaaaaccttgtctctacaaaaaatacaaaaatcagctgagcgtggtagcatgtgcctgtagtcccagctactcagaaggctgaggcaggagaattgcttgaacccaggaggcagaggttgcagtgagccaagatcgcaccactgcactccagcctgggcaacggagactccatctcaaaaaaaaaaaaaaaaaaaaaaaaaaaaggccgggttgggggggcttttaaatcattggaagggtggagggatcaagtggagataggttatgaaagaagctatgtcaagggtgaatgtaactcaaaataatcacacatttaacaagatacttcaactgaatcttattttagaattattgtagttagaatttccttttaaagttgtaagtaggtaacattttatttgaagataaatttatatgatttttatattgtataatgagtaaagaactaggatacaatgaagtctacctctatttaaaggaatgatgttgacaaatatatacgtgcatgtattttgaagatttcattaaccaaaatagaagaataagaattttctatcagcactgtttttgtttggaattaaacatttccatactaatataaatgccaaaaaataaatcaacttttacatttctttcagttttaatagtgtaagatcctagtgaaaggtaaggatatgtatattaataaatttttattttttaatgtccctaaaaaatgtgccattttaccatgtttgctccgttattacttgcatggtcttatgtccagtttgtggttagtaattgaatattgtgcatagtatcacagtatagaatccacgttcattattctctaatcatagtctcattgttcttgtaaattcttcttcctgtatttattgaagccttacacctttttatactgtagtcaaccatccaaaagtaagaaggcatttccccctctaataactttctctgcagttatcagtcagttaaaagagcccatgtagttttagaattagagatatagggtggaaaagataaaatactaatttgaggtgtgcgtgtgtagtgtcaggctccgtacttgagagccaaaggtttaagagtcttgattttatgccagggatgccttcactgaaactcacccaaatagcagaagactgttttcatcaatttactaatatcaatgttatctagcaccacatgttttctttgtcctattgatttatcatgcgatattgctttgatgtgttctgttgttactttgcgcctttggggttccacatgccttcgtgggaatctcggggtgcaagtaacactgtataaacgaaaatactttgaaaattgcagtgtaaacaaaactagctcagatgtttgacactttgtttgaagtctttatttctcttgttttctctcaataggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataagttacttgcca

SEQ ID NO: 1116 - DNA, 74818 bp, mus musculus; identical to SEQ ID NO: 1115

SEQ ID NO: 1117 - DNA, 4868 bp, mus musculus
catatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaaaggctcaggccgtctttatttgtatagcagtagttcatgtaacattatccataggttcttgaagactacaacattaagcaaaacaatgtacagcaggtgtacatcgtacaacaatgcacaatgtatgacattgttcaatgttgttatgacattgttcaatgttgttatgacattgttcaatgttgttatgaccttgttcaatgttgtttagttatgacattgttcaatgttgtttagttatgacattgttcaatgttgtttagttatgacattgataaggggaaaaattcattttgttagatgttatttcacttgaagtcacaatttccaagaaccagtggactatgttaagtgaggacttactgtattccatcaggtcccatcacgttaagcatggccaaattataggagatttggaccataggtttacaagactctttatttttttaaaagacagggtctcactctgtcacccaggctggagtgcagtggtgcagtcatggctcactgcagcctcaacctcccaggctcaagcaatcctcccatctcagccccccaaagtggtgggattacaggcgtgagccactgtgcccagccttggctagactcttaactgtactccatcatcttaacaaacacagctcttggttttgttcaccatgaaacttgtgatatgggtcacaacccaataaggggtatggctattgagaagataaatgcttgcaatggggcctttggtcattgagtaaaaactaaggattagtgactcctgggctgggaaatgagatgatgtcacctttgtctctttcatgcttgggttgataggaaaggtgggaagtcatttttaaattcagatcatgacctacacttggggtcagaggcactggatacttctctgaacaacttcttgaggaaaacaccaattatggattctgaggtggctacatttattggcaagagagtggccttataacctgcaaataactgtcaacaactaaagaaccttctgtcttattaagtgggtagtgccttaggcacagcagtatacctggagagagagacagtttgctttgctgtcaaacctcatactcatgagctagttgaataggtgtggggactgctggcacaacaccctgggctcattcatgctcaggtaaaggcaatgtatccttctacattgtccctttgtgtgtacatgtacctccagggtgtctaacctgtcagagatagccacactggtcttgttggagcatcagtattttggctgtactgcccataggtcttcagggcacccatgtgggaaatgaggatttttattttgtcatacataagctaacctaatccacacggatgtgcctcatacgtcttggacccagttttttaatcattagaatgtcaatggcaagagttttatttttatcataagagctctatgcactgaacctcatacaaaatacaaaccatccagtacttggtaagttttgccctggaagccactttataagcaattatttttgctgctgcatcaatctcattgttttgtaattttagtgatttaccagtagtattttgtggctgtgttccactgataggccaaaaccacaagccaggacagaactctttgtctccatccaatttggatgatttcccatcaaaaactggctcctaaatgtctttctcattagccaattgtttagcaatttccctaccagacattctgaactgtttatatataaatacaaaaaccttcagagaaaaagacaatttttggaaatagattttagaaaccaattatttgcatttcagtgagaagcagatcatccaggtgcttggagatactggactgtctctttaacaaagtagatacaaattcgtggtaacatttctttctaacttcctggatacatttctttatagttgttgatatctgatggtgttctccaatactccaaattggggccattcacagagtactagtttccctagggcatccaactatttataaaaaccatgttcagggcagtttcctttcagagatcccctatttcctctaattcaggtcagtttgattt

SEQ ID NO: 1118 - DNA, 4868 bp, mus musculus; identical to SEQ ID NO: 1117

SEQ ID NO: 1119 - DNA, 125898 bp, mus musculus
tggctctttcgatctgagacaccccctcccggagaactcgccccctcccccccagcccagagcggagtgaaatcttagaagccgtggctgctgggtttgaacggaatgctggagtcagtggaagacggagctggtcggcccgaaggtcagcgagttgttttgagttctcctacccggaaggtagggggtggggtggggtggggagcagggagtagaggacgccagggcccccgagagaccccgcgtcagagcaaaaattgtttgtgccccggaacaggcagctcagcggaagccgcgacgggggcgggtcacgtgcggcggtggcggcgcagctggcgggggagccgggctgggacaagggccgggccgggcgggggtggcgcggggcggcggctctcgcagccgaaggtggaaccggctgactctgggcgctgggagcgagcggctccccgagcccggagcgagggaggagcgcgagttatggagggaccggtgtgggagccagggcgcgcggagctccgcgtggtgcggcacgggccggacgaggaatcgttggggggcgggggcagggacacggaagcgggctcccggggcgagagcggaaccgacgcggaggctgcgagggcgtctgaaccccaagaatggagtcgccgctcttgtagtcgccggccttgttttcttcttgcacgcaaatcccggaacgaccggaaccgccatccccgcctgcgtcccaggggcgccccattacgcatggcgggggggcccgcggggctactccgggaggggatccgtgaggccgaggccggggagggctgcgaggtggctcgcgggggtgcaagccggagcggggctacacaccacacaaacagcctccctttcccccggaagagcgggcgagggaagacgcgggctagctctgggggctccccaggactgtgggagccaggcgaggaccgcaaggcggaagggagtgctgcagacaaaccatcggccccacctggaagacattggtggcctcgtggccggtggtgaacggtctcacgcttccccaaagtggcgtgcgctactctagcgtgggagggaaaggacacaaacttggccatctgccagaacccttgaagacgcctgtctttggtgtccctccgccccccgcagtggcccgaaatgtactctccctcccgtagtccacgaggttcaggtccgaaacctggaaaagtagggtagcgtggtctggcctcggacgggaaacccacccacgttcttctgaggtgccacgcggggaaggcgcggaacagtcttcttgcaaagtttcccgcccctcaccccagtcgagtaagggcggctcttccggaggtgggggcggggaacggtctcgtagcggggagtggtgctagttcctcttccctgcgaccgctcgggccgcctgcgcgttcgcgtccccagacgctgcaccccagtttgctgcaacgtctgcttggagtcgcggtagcgggtgctgcgcggagtctaggacgacgcgagacgccatttgcatcccccctccctcctgcaggttggcgagggcggcggtgtcgcccgccgcggaagcgtattcctggcagtgacactgattagatgctgtgtcgatacgtgcacagaatcggggtgggccttcacctctcgtgtgcgcacacactttctgttggaaaagttgcgatattttttctccccctctcgccgcacagctgctgtctcccgggcggaattaggcgaccacgtttgctcaacccgaaggagagaggatcgcgcgggcgctgggcggccgccgggcccgggccgcgaaaatccagccctggctttgcgtcgagctgctgagtgccgcgcttacgcgcgcggggccagccggggcctggtttccatctgccccttttgcctccgtgttaagttcgccggggaaaacccaacgatccgtgctgagcccctcggaggagagcccccgccccaccccacccccagcccgatcccgaccgatggaaaaaatgacagtataggtcagaacaggctgcccgcgagtattaatatggacggcctccgttcctggtgcttggggaggatgggcgcttcgccaggaaaccgccgaaggaggcgccatgagggccgcctgccccttctcgggctagaaaacgtggattctcagagggaccagacaaatgtggtcagatagctgcaggaacttaccccatctaaatacaggttgcccgtgtatattccaaccaagatcatttttgtttcaatctaatacacgttgaatcaattagaaatactgtgagaaactgtggtcaaacggtagataggaaacttgctctttgcctaacattaaatgtatgctcaggaggtgcggggctgagcactatcggcgcagccagtctgtgtcctaagaagacagggtcccctttgcgttccaccttccaggaccttaatagaacgcgaagagaggaattattttagttgtagtttctattagagggttgcttactccttgcaaactcccgcctggggttgtcggtagttagtagtagatggttctgcgttttggcttttacagtccacgtttttctcttggctttttcttttcctgcgtacacgctgctgggtacggggagggggctgcccagacgtgtgctgccgccgccctcgggctctttcttgcgcaccacgcggcctcggaggaggggaaatgtgaactctccgggtggcgctcgagaactggaattctgatttagggctgcgggtttgttccggaggctggctgggagcgtcttgtaggggccggaggctgtgaaggggaagccccagaggtgaccctgaggcctcagaagcaaacctggaggcgcccgtgttctttgtctttctcggggctggcagcttggcacgcacagttccgataaggatctactgagagctagagcgcactgccagcacatttcagtgattaggcaaacgccggtagccacttaaggcaaaggccatttgcgttgtgtttgaaaaggaaaaggcagcctcacctaatgaattatgggtgaccctggagaggccaagcaggggaggccgaggcctccctaggctcttatttgccgcaactcctcccctttttgccagagtcgccatttcaaaggtaatgggaagccttttgaaattagaagtctgaccgattctgtctacagaagtggtatttgcatctgtgcaccagtaaaatgtggcccgccagcggcccagggacaaggcctgccatacgccagccctgcaccagtgttagaccaaagtacatcccagaggacatggcttttggccaactcctccgagaactgatttaaagaggtggccttcagccatcaaaaaaggtgtcctggaagagtaggctggaggtcctggaaaccagcgctcttccccagggctgcagggagagagtgggtaatggtgcctgagccctgacggaacttgctattaatccagtctaaatgagcaccattaaaaaggactctccctcctatccaccaccacacacacacaagcctttatgggacggtctagtggagacctagacagtttgagggcatttggccttcacttttcagtggccatacaatagtgccctttccaccctgccaagaccactggctccatgtaaacttccaggaactttaacccggaactttgtactccctacccatccaaagggagtgccagatcatagtaacaaacacacgtagcattgtactggaggcagcgttctaagcaccttatgtatggaggcatgttatcctcagaacaaccctacgaggtagataatagtattggtcttattttacagatgaggactccgaggtttcgaactgttaagcggtttgcccaaagccgcacagcttgggataatagggcctggattgaccagagggagagatagggcctggattgaccagagagagaaatagggctgtgttgcctctctagcgttttgtaatgaaagtgatctgtttgggggttgtttcgagaggactgcctggaccccaaccttccaaaggaaaatatgaagagactagaaggcccaacatttggcctttattttgcaaaagaaagttctggagagtcgtacagaggcatcttactgtggctcctccgcggcaaggaaggggtcagggaaggcaatgcaaaggcccccctggcccacctagctgcatagcatccggcggtcacgtccgccggaggtgactggggactggggacagccgattgccgaggaactccttatcgcccagtgtcagtgctcccgggtgccggagctaaacgtccgcctgcgggggcggctagttcacaccagtcccctggctcccgacgcgcccccgggcttctcccgcggagctggctagatgcccggcggcggctccgaagctccgggctccccgccgcttgtcccgccagcccgaggcatggagccccacggcccaggactggagagcccagttcgtcagtccaggttgggactgctggttccgggttgctcacgatcactctcccctcaacacccgtccggccagggcgcgcgcgcagacacataaacacacacggcttccaagcgcgcagcccgcctcccgggcctccgcttttccttcctcctccccgctcgggcgcttcggaagcccgtggcggttgtgtgctgcgccagggaagagtccgggtcggggagaccgcgctgccctctttccccccaaggtctgcgcgcacgctagtatccttaggaagcacagtcaggcttgtgggttcccatcttcccgggaaatgacggctgctggcgaggacctgttcgctccgtgtttcgcaatggcccggggatcagaggagaggaccgggcggtggggcctgcgcgtggatgagggtggcggtaaatcccctctcccgcgaaggtggctgagcctccggccaccgctagtagtagtctaccctgctcgtcttgcattggccgcagcttgactcccctgcgtgccgcgggtcggtgtgggtgtccccactccctcaagcctttactttcagctcgcgaaaccccatggatccgcggctgggctgggcagcgcagacgcccagctgccctcgccaaccccaggcccagagggggccaggctggcctgggggctgggcggcccggctgcacttgccggcgttgagagaggctctgtgagccggagccggccgccgagccgagggagagagcgcatcagcccgcgcgccttaaggcagaacacacgcctttcccggaaccttgaaacccaggggagccgctgccatcttcgcgtgacgagcagcgagacgccggtgattaagtgtttctttccggctccctctccgggttgcggctctcctcctttccacagggctggaagaataaaaacctggggaaaaaccacacacaactgcgctctggtctcgctcgccatgtccgcactggtttcttagggtgcgcccacgcggggcaccccctgctcccctactccacgcctggccggggtcgagggctgcgtgcctcggtttccatccgctctagcgcaaatctcggagtttaatggggagggggcacacattgctgaagccacccgacccccattctccttacgccccccccccatggggattaaacctaaacacatgaatcccccacccatacccgggactaatccagccgcgcctcctgggattaactcggctcacaggtccataaaacacttccggcgcggccagagggtctgtctgcagaaacactttaaaattgtcctcccgggcctggagtcggaattgactgggtggagggaagtgagtaaacagacagttgtaagagacaatccgtgaggtttgcaggctgtgaaaagagctgcttaaaatatgggctgtcggggttgcctccagcaggagggtggcccgggtcctagcagacagatccaagaaaaggatgcaatatattctaaatgacattgacctggaggaaggagggtgtaggcaggagcaggctggcttcacatggcttctggctccagttcagtgaggaagactagcttccagaaatttgtgggggcgagtggccagtctcttcatgtgtaaaatcagaacagtaacacctactctgtccccctcggatgggtttctgaggaccaaaatgtgaaggcactttgtaaatgcggctcaacccttctgcttcactgtggttaatgttcagtctctcttaggtagaaaaaccagtgacttgctgattagaaaacaaagtagaaatcagccctttctcaaatctacgcaacaatgttcgagataaagggaacccaaaagcaacctaatattttgaacctccttttacatcatttcgagataagtttctgaagtaatgagagaatctttggaatgttctaagaaaatctgtcaaaaactggaggttaatggggaagaaagggaggctttaaattgggtcaaatcacattttaagaaggctgggcgcggtggctcacgcttgtaatcctagcactttgggaggcgagatgggtggatcacgtgaggtcaggagttcgagaccagcctggccaacatggcgaaaccccgtctctagtaaaaatacaaaaaattagccgggcaaggtggcgggcgcctgtaatcccagctactggggaggctgaggcagaattgcttgaacccggtaggcagaggttgcagtgagccgagatcgtgccacttcactccagcctgggcaaaagagcgaaactccgtctcaaaaaaaaaaaaaccaaaaccaaaacaaaaccggaagaagaatataaatttatagtagcttcctggctatatccccttctgttagtctgcagaagagatgcccgttggtagccattcccccagccccaggaccgaaggacgtcttgactcaggcttggtctgctaggtgcaaggtgttgttggcgtctggggtggggacagtgaagaaaggcgatcattttgctttaaatgaacatcagaagacccaggcctgctactgcgtcttgaaggcctggagttgttaaaactctgtgggagggggtgcctcgtgacctccttcctcgcagatgggctcaggcagcgtgaccggccccaggtggtgcccaggcgcgctggggatggaggcccaggctgcgcgttcaccctgcctcgcagatagcgagtaggggcctccggctggaccgcccaccggccttactctcccttccctggccttggggccttggaccagggttaaccctggtcccgtctccacctcattgccccccgtgcagcgccgtccccgccctggctcccggcccagatcccgaggcctccctcgcccagcagtctcggttcttccccctcgtgattcatttagcagcggtgcagaaagcctgtttacctccgcagccctgggcgactcgatctgcgtaaaaagccccaacgccagctccgaccagtaggggggggattgtcctatagattatttctcctcctggtttttgtttttgtttttttttaaaccagaaggcttggttgaagagggggtggggtggcgtgttgctgctgttttttaaaacaccgtatttgaaagagaaacaaaagccacacaaaagccgtttaggaggtaccaagactgtttttacatataaaaagtgcagcgaataccaaggggcccccaacagtgataaactaaatggttggccgatttcgacaattaacagttaatctgttatctgcgatcagcaaacaagttttgaggctcgaaggacaccgaattcctgttccagtcgatagcgttgtactcgaatctgttgagcacatcagatgctccctgtttctcctagagcgaatccagctttagcaaacatgggtttcccaggttgaaggaccgacttgagccagagaaaattctcttgtgcagctgaggagcctctgtctgcatcgcccctcgagcccgagctcatctgtttggtttagatttctccaaattggttttcaccccgatttcgcggacctcctaattttgcacgtaataggcctccgataaatgtgtactgaatggcagaaactaaagtgaggccctcggcctggaagacggcctgacgcacggcctcgcccttggaaccccactcgggttcccagagcccccaggccgctgcagcctgcgcgcagcttcgccctgcgccggccagggcgggcgggcgggggaggccaggaggcacgaagcgcctggagcctgcacgatgataaatattgcgcagacagcccataaataatttgcattatgttcagctgacaacgcggggcgattaattttaatagctacatatttgcctgggctgctgctttcgtaggccccgtaatgaaaggcgagaggccgccctggctccgtgctcgcggtccaggaaggcagccgggggtgcgggaaggcccgatgtggcgtctcctccaggcagccccccggggagccccagccccttggcccccctctcgccctccgtgccttgtggaggtgaggtgtgcgcgcaccgccggagcacccccgaggcctcgagcaacaggagccaccataatgacactgcacatttgtctgtgtggggagagccacttgtggactgggagaccctccacgtagctttgtgccccacccggaccaagtccggagtttcaggttccacttaggctaggaggggggtgtttgccgccgccaattcgccagtgggccccagctcggccgaggcttctccgccctcccggcagaggcaagagacaaaacaaagcccggctgtccccgcgtcctctccgcgcgtgtagggtcctgagttctgcctcccaggagctgtccggcgctccgcggaaggcccccctaaaatgcttcctgagctccttgatgcaaaaggaccgcacacataaaggacggaagaaaagaaagggtctggaggagctctttaaaagagggggcagggaaggaagcgcagcgaggaaggacgcggctgccgcggtcccgtggtggccgggtgcgcgcgtgtgcgtgtctgtgtgtgcgttccgatgacaaagccccgccgccgccagcaagctcctggctgccagagctctggtgggggaggggaaagggaggagaggagccagcgctagcgtaggtagcggggaatcgaagcttcccaggagaaagagttcattcatgagctgtaggaggcctcgcggcccggccaggtggagcctcctgaagccaacacctgtgtattttcctttttggaaacaggcgagcccatcgatcattaccatattttaattgcctttcgcaaaggtcatctctaattatgggttgcgaggagggttggtcaggagtccgtggccctttattatctgtgtgggtgtgtgtgtgtcgccgcagagacaatgcgcccagctcttatagaaatgccaatccgagggtgtccgtgcgcgcctgcgaggcggtcacgacgtgctggatccacgcagaccaggctgcgtgcacaataaaagccgagcaggcggctgagggccgcgcagacccacgggttttctttttagaaacagtggtgcgaagagacttgacaataataacacgcagcaggattaaatcagggcgggaataaggaaatgtattttcgtttctagaaccgcggactgtgtttaacccatccgatcctcccctccccagagcattttgtgcacacgtggagttccgcgcagggacaggcgccgggcacagagtggcttgggactgcccgatgacgttccagggcagccacgttacgttcatattaatctcttcccttaattcggcatggttgtcagttacagtgacgtgaaacagccttaacgatgtctgttttatgggaaacaatacctggctagttgaaaaagagaaagcaaacgttgaggttttttaacttttgaaagtttgcatttccttagtttttatcactgtcagaaacccttgtggcaaaagcctattttaacttcctccgagggagaagagcagtggagaaggtagatggagggtcaggggttcttgggaggatattttggagatggagggaggtggagatcagtgaagagctgtgagtcaggggtggtcagcagccactctgaacttgattttctcaaaggagcctggcacttctgagccccgatgctgtttctggtagtccagcctgacaaagtcagaggctggggtcaggagcctcagagagttggagagttttgtactggtcctgcttcctgcctgcccccacacctggcctcctggcctcaccagcagccagctctgccctgaggaaggcagagccagatgactggtccaaccccccagagaccgcctggctttctcctcccctgtaatcataaccagatgcacttaagcgcctttcatcagaggaagcccaaagccctttaacaggcttcaataaaagccttttgagggcctaccagcctgctcagcgttggggcccctgtgcccactttccacctgagccagcctggggctgcagtcagggtctagcctctcccctggggccccagaagccaaggaagtttactcaactaaggcaacctctccaagcaggtagggtgccaagattcctgccaggtgtgtgggttcagacctcattaacaggaggaaagaaaggcatgggagggaagccagcagctagtgtctgtcttaaggaaggacaagaaggagcagcctatgagaaggaaccagaggggctaggaaatagagccggggtgaaggggcagtgatgatggagatgttcacaaagactcccatggtacttccaccaacccgaattcagaggtcagagctgctgtcccactgtgttgcagtctgtctcccttactaaactgtgaactccctaaggggagggactgtcttattcacctttgcaggcccggcccgggacctggcacaaaataagtaatcaagatgggagatcacaagctacgatggaaaactctggatcaagatgcatacgggcttaagatgggagctctgcccccagtggttgtgtagcctatctgagcctcagtttccttatctacaaaatgggtatgagaatgcctacatcaaaaaattggagaaagatccgatgaagtagttgcaggtgaagcaccaggaagatgataataaagtttttaataaatactgtgccctagctgggtgtggtggctcaggcctgtaatcctagctactcgggaggcagaggtgggaggatcacttgagcccaggaggtcaaggctgcagtgagctgagattgtgccactaagtgacagagtgagactctctcaaacaaagcaaaactagatagatagatagatagatagataatctcatgcccttgctcttgaaggagtgaagagaggatttggactgatattgtttgaattgtaagtaggaaggtttgtgttacaccctagctaggcacaggtctctctggcctgggatttggatcagaagaaggaattgtttctaaactgtgtgaattggagccacaggaccccactgcactgtccaacagggcaagcagctccaaagctgtgaacttgggaagccaagccagccttggtctcaggctctggggaaggggcaggtcctagacccttggactctcctgcacagggctggttgtggctggggcctagttgtgcactgcggaccaggctgctggagatgagtggctggcagataatcccagttggtgctggctttctgtggtcaagaggagaactgccccttcagctttgacctctgctccagtaatcatggctgtattttatttttggcgggttcatcctctggcatttggcagggcggggaggggaagcggggttgcctgcgtctctttgctattccttctggtctgctcagtagctccccacctctcatcccccaccccaccccacacaatgtggcctggttttctccccattgcaagctgctttatcatttttgcctgttccctggctgctctgcttgtttgagagtgggggtaagacctgggctctccccattcccctcctcggtccatcacattccagatgtctttcagcccctcctcccatctccctgagcttggcacttccccaggagggcagcctgagggtcagggtccatgggccgcctgggcatcaggggcctgtgagtgcctggctcagagaaggaggaaatggtgggggacagaggccagctgcactgctgcacattcctagctttgtgaatggaagctcatggcatttggtgtgtgacacaagtctggtagtcggggtcagaatgaaaaggtgtgggatttgtaggggaattgggaagaaaatgaagtaagctaacacttcttgcataattcatccctccctatccctgagatgagcaccctccaggagaggcaagaaaaacaagagagaagagaagagaagggagagcaaaaccagcctggtggaaatgctttgcccctctcccttcctgcctagggaactggctcccttgtgcagccaatgtaggtcaggaggggacaatagttagggtcctttacccagatcctctagggaaaatgtgagatcagatttgaggaagacacaggtcactgtcctacagggatttcagaaagaataagacactgcgttatcaaaggtgggggatttgggttatgatcagaaatttccttaaaaaaaatttcctgcctgtcacacttttgtttttaacccagttcaccttcttccatggatttagcaataagttatgaaattgatctcttcccctatagcatgtcagctacaagggagctcagaagcaatttaattctgctcctggaatctgtgggtccagaatttggtggactcaacagctggaggctggaagcatccggaggggtctttactttatgtctggctgttggctgggacctcagctgtgtcccatagcatgagcacagggctctctatgtggcatgggcttcctcacagtatggtgccttgagggtaataggactttaagttacaaatcggcagctcagggctccagaaaaccagcattgcagtaaataaggctgaagctgcatcaccttttttttttttttttctgagatggagtcttgctctgtcgcccaggctggagtgcagtggcaccatctcggctcaccgcaacctccgccttccaggttcaagagattctcctgcctcaacctcctgagtagctggaattacaggcatgcaccaccatgctcggctaatttttgtattcttagtagagacggggttttagcatgttggtcaggctgttctcaaactcctgacctcaggtgatctgcctgcctcggcctcccaaagtgctgggattacaggcgtgagccaccgtgcctggcccgctgcatcaccttttctaatccacccttgaagtctatattcattggttgcgattgtggtcacaaacccatccagattcaaggggaagggacagagatcctacttccacttgggaggagtgtcaaagaacttgtggccatggtggggtgggggtgggggtgggaaggtggtaggggaagccataccaggcacctttgagagctaagcttaattagcagtagctctaaacagactagtctacattgtaataggggtttctaccctcaagaggcctcataaattatatgggggcagggggactcagagagctaaaattaggccagggtaaaagaaatagagcctataaagcaaatatggattttaggaaaaatagaaaatatatcaagacagctgtctctatgatcttgtccaatgtgggaaggactgagggagaactgagtggtgggatcagatgggttttaggctcttctgcattgaaagggaagcaggtaaaagattagcattctatctgccgccatccttagcctactgtcttggggaagatctagtaacccttcatcgctcccaacaacattattttcactattgccttataagtcaccgccccctctaccaccagtatacagctatctttatatggtacaaagctaggaatgtagtcaatgcatttcctgtagtgtgtatggaaaaacaattaatacttactatttgtgccctccctgaggtgtggttttaaatatccagcatggatagtgttgtgactgaaagggcctgggtacatctctagggccccaggttcccattatccttgtctctaacccctgaatggagagtttgacttctaatttcatgctagaggtttcacgggcataattgtatttgcctctgcctttgatctgctatttgatctgctagtttattgtgggttcgactaggagacacagatagaaacgtggtggaaaacatgattttgttttgcttgggaattggcagttattattttctatggctcccttaacatgacacatcttccctaaatccaaaatctaatcattttcccatttttgaaaatccaaaaggcatgtgtaccctctggcctgctttcctctcccctcctgaagatttcattttcagtaagactttggaggcatgacgttcagattttagacctcagtgcagattggagccccgaattagtgtaatacacctgggtgaactctgccacacctgcccctttcctgacctcaccacggcttcccaggatgtatctggttcaccctagcctcccttgaggtgattttgggtctgcagggccaactcctatcctgagacccaaacaaagaaacccagattcagcaggtgggtcagaactaagcgacattcaggggatggcccttgaaataagctggcttctcaggcagggtcactgtattacattgtacagtttgtgtactgcacaaaggtccccagccaaaacacagaataggctactggcagctctgttctcagggcaaaggagaaagagattatgtctctgatccagaagaaaagagaaggtgacacaggacagatagaggtcaaaagggtttcttgggagcacactggatcagcctaagactggaccaagccagtgttgacccagcatgttggcgcggtaggcctatatacactctctttgttttgttacctctcatctgcaggcactggttcgtaagttattgggtccctcctaggccttatttggagtgtgggtgggagaaggacaggagtgtcaccctacttatgtgtcttgtttagccagcaagatgggatttgtttcttgggcagagggagtttctttggtttatgaatatgaagattttaaggcatattgttcactgcagaccgttatgtacttgatgtaggtgtttgagtgcaagaccctaacagggctaggcgcggtggctcatgcctgtaatcccagcactttgggaggccgaggcgggcggatcacgaggtcaggagatccagaccatccaggctaacacggtgaaaccccatctctactaaaaatacaaaaaattagctgggcgtgatggcgggcgcctgtagtcccagctacccgggaggctggggcaggagaatggcgtgaacccaggaggcggagcttgcagtgagcccagattgcaccactgcactctccagcctgggctacagagcgagactcagtctcaaaaaaaaaaaaaaaaaaaaaaaggggagaatcggcctggtttctggctcacacctgtaatcccagcactttgggaggccgaggcgggcggatcacgaggtcaggggtttgagactagcctgaccaacgtggtgaaaccccttctctactaaaaatacaaaaattagccgggcatggtggcgctaatcccagctactcaggaggctgaggcaggagaatcgcttgaacctggcaggcggaggttgcagtgagccaagatcgcgccacttcactccagcctgggcgacagagtgagacgacgtctcaaaaaaacccaaaaaacaaaaaaaaaccccaaaaaacaaaaaaacaaaaattagccgggcatggtggcatgaacctgtagtcccagctactctggaggctgaggtgggagaatcgctccagcccgagagccagaggtcaaggctgcagtgagcccagatcgcaccactgcacttcgacctgggcaacagagacagaccctgtctcaaaaaatatgtaaataaataaaaattaaaaaaaaaaaataaaaaaggccgagttcggtgactcacgcctgtaatcccaacactttaggaggccgaggtgggcagattgcctgagctcaggagttcgcgaccagcctgggcaacatggtgaaaccccgtctctactaaaatacaaaaaaaaaaaaaaaaattagccgggcgtggcggagtgtgcctgtagtcccagctactgaggaggctgaggcaggagaattgtttgaacctgggaggtggaggttgcagtaagccgagattgtgccactgcactccagcctgggcgagagagcgagacaccatctaaaaaaaaaaaaaaaaaaaaaaagtagaggatcatctgaagaaagaaattccaatcaaaattaaacaactccaaaaaggaacttttctagtgtcagtaatgggctggttgaggaggtctttgggagccttctttttattgattgactgattttttttttttttttttgagacagggtctcgctctgtcgcgccgctgcactccagcccagcctgggtgacagagtgagactacatctcaaagaaaaaaaagaaaaagtaatccggccgggcgtggtggctcatgcctgtaatcccagcactctgggaggccgaggcgggtggatcacgaggtcaggagatggagaccatcctggctaacacagtgaaaccctgtctctactaaaaaaaaaatacacaaaattagccgggtgtagtggcgggcgcctgtagtcccagctactcgagaggctgaggcaggagaatggcgtgaatccgggaggcggagcttgcagtgagccgagatcgcgccactgcgctccagcactccagcctgggcgacagagccagactccgtctcaaaaaaaaaaaaaagtaatccatgtcaaccatctgatggtggagggggatttcagatctctgtaccatactttcccttctccattcttaccatagcactagagcacaatgccttactaaattcatatccagtgtttactttgtaaccacatatatatcattcattgctgagccaaatgagcttcagtgattgcagttcctttcttgtaagatttttttttcctggagttaataattgcctcatttttatatttgcctaattttctttgacctatgactacttttcccatactttccaacctctgtacaattaatctgaggacaattttctgcatgtccaaatcttgaagaccatctgcaaatgggctgatctttttttgctttgtgtttctttttttaatccctattttctttaaatctgaaaactttttcaaaaagtttccaatcttccatttagttttattttctaaaacttttggccgggcgcggtggctcacgcctgtaatcccagcaatttgggaggccgaggcgggtggatcacgaggtcaggagatcgagaccatcctggctaacacggtgaaaccccgtctctactaaaaatacaaaaaaaaaattagccgggcgcgttggcaggcgcctgtagtcccagctactcgggaggccgaggcaggaaaatggcgtgaacctgggagccagagcttgcagtgagcggagatcgcgccagtgcactccaacctggacgacagagcgagactctgtctcaaaaaacaaaaaacaaacaaaaaaaacacttttatgaaatgcggtgggagtttttactgatttcaaatggggtattgtgttttggtgggaaattgtgtctgtcccacccagctaatgtcaagagctgagaaattaatccagagtttctgatatttgatattttgcttggttgaaataaactttcatcatttttcctaaacaacaacttttcagaagtaatgactgttagccccgggaaccgtggaaatattcagtattagtaaatctttaccctcccctcccccccgaactgattctacatttttagaaataaagattatttttaaaataattggcctttacccaggccatttactgcaagattcatgccctttatttacgttcacctcacggtgccttttatttgtgttcagtcatttacaagtctgcctttccaactagattgtaaattacttgagggggccaaaggtgtcttttaaaaattcacttctgtacttttggatccccctaggtcctaacacagcgcctcgcccttagcaagcgctccataaatgcatgttaaattcaaaaagtggacaaataaagttccagtgttctccaatcaggagccctaaaccgtggtaactctcaaatcctctctggcctcaacagcgccctgtgaacggtgggtaggcctcgccccccacccccagctgcctcggcaggttgcctctggggacagagttctggggtgcgcgggagaagcgataacacgttgaccatcgcgggagtccgggaaccagaggtcgtttctcaggattaaaatccgctccagcgtttcgaggaggggcgacactacaggccacgctttcaccagggacggccgccccatcgtccccgacctgggtcagcgtggcccgcagcggggaggggggcctcgggagggagcgccccccggcagcccgggaacgcccgcgcggcagccccggcccagcctgcggctccgcggtcctaccgccgggggcagcgccgcctgcgcagccgggccaagatggcggccggtgcgcagccgcccgcgtccgggggagaagcggcgacagccccgtgtcagccggggcgcgcgctgtcccagggcgcgaagccgctcctcctttacccacggggaccccgagggccagtcctgccacttcgtcctgacaggccccctgcccggagccctacctggacgggccccggctgggatcgggacggccaggaggatggccgcctggctagacatggtggacaggggaccagcggggaccactgggtgccagccccacacccaagccatttcttccagccctgggacacctctggtgcgcaattcgacattagtaaccgcaggtagggcttcatgccccgtaaaaacacagggctcaaagcacttgaaatcaggaatgtcttggaaaatctgctacttctggttgtgaaatccacggtattctctagtaaaggcagtaaaggctacagaatatgtgcggttcctcacatttgctgtgacatcggtatgcgcgcagtgtaggctgcctgcctcctaggacactccaaaacctgaggtccaatttaccagaaatggcattgatgaatgcggtgcattctgagtgatctcccgctgggctcaggttgggaggtcagaagggcccccaaagggagcagctaatgcaggtagaatcacaatggtagaaacagagaagtacccagaaacggttccccattaccctttgtaaactgggttgacacctcccactggttcaaggttccaaccaaagtttgcatgttgtttatcagctcagcttgagaggcagaatgtgaactttttggttttgttttggtgaaatagtctttctgcataacatttgcaccggcttgttattcttatggaaaacacttcctccacctaccctgggcagcagccacaccagcctttacttccttctgcaggccctcttaattacctctctcttgctccagtttaggcagcccccggcactttgttcaagtacagcaataaacccaagactgggcctaatcctctgtggtcctgaccttccccacagcgggcctggagtctggagggcctggagtctggagggccttcctgctcccctgattagggccaaggacgcagcttgatgtgttttgtgttttctcccctctgcacacttggtacttttcagagtgcttcactaaaaaatcagatacaagaaaaagttcacatcagccctttggagccaggcctccgtgagctggggtcaccccaccaccaagccaaccattcgacttctaaactgtagccagggccaatgggttaccgctgaccttttgcacaccgaattcctctcctagcgttagctcgggtggccagggagcctcagctgcacccacctcctgcccggtccagtcccgatgcccctcgcgggaagcgcggtaaccttaaacggcacgacaggcggctggccgagctggttcggtgacgactccctggagacagcggcttcgagcagcaggccccatctgcagcgcagctgaacgagttaagctgccccaggcgtgagcgtaccaggctggggcctggacaggagagaaccggcggggggccccggggcgcctaagccctaggatttccaagttgcagggggaaaggtgaacctgactcccctcccgaagggctgcgtggggggctcagaagactcctgtcaggggttggggaggcgcctcgaagcggggcccagagtgaggctgctgaaagggggcctggggggtaggcggtgcgccctcgaggccacctggtcagtaaaggcgcttctgtgctgtacaagcaagacagcagttgtagcacccgaccctcgggctccagtggcccacggtgcaggcgggcaggggaagagtggctctgcgcgcagccccgggtgccctaaggtcacctcctcatcccctgccgctgctgtgccgccccagccctacccccgccccgaaaaaacccggccgcgcgggccagagcctaagctgcacgggctcctgaccccggctcgccaggctcagcccagtccgaccccgcctcggcttcacaaaggccacgtgcggccagggccgacaaggaacgaccacgactctcagatctttaattacgctaggagtccctacccttccccccaacccatcgccggcttccagccctttaatcaatttcacgatattaaatattaatttcctgccagccacggtttctcggaggagggggaggggatgggcagggcagctccgaggctggaatggctttgcagggtgtgaccacgacagcagggcgcggaggacgcgcggattcctaagtgagctgtgcccagaactcggagccactgggttttcgctctgtagctggggaacttggagagttatgagcgcctgggtgcaggcctccaggaggggcagcgaggtgcgcggagagtccgggtgtgctgggcgaccgcctcctgctccgcgcgccccccctccccaccccagccgcgagtcagcctcacgcgggcccgcggcgcgctgcgatgatggatcgcgcctggcgggggtgatttggtgttgatcgcacattatcactggcaggttggactggttgctgatggacgacttctagcggcggcggcagcagcgtcttcagacaccgcgctgggactcgctcgctcggcgagggtctttcccccccccacaccccctccctacttccaggcgccaggagggcctgagagtccgagtggggtctcctcgcgtccaaggccgcccgctcccgtctgggtccgggtgtgggctgttggctgggtgaggagaggagccaggacgcctctcccacttcctcccactcctccttcccttgccgcctgctccccacccccttcctgcttccccaccgaaacccggaggccctgggtcactccgcgggtgatatccacgccgcctgaccctggccgcgggggtgcggactcctctgctccgcagcccccgaccctctcccccggtcgcagcagccgcggcactgcggtgcgccccttctcgcctctttttctaaagtgcctgcagatacaaaagcggtttcgtaatgccttccgtctgcgagagccggaggaccttggctgacctttcggaaactgattgcaactgcctgttaacagcccgtactgaccgcactgagcggagcggaggacaatcatttaagtgacagacggcgaggtggccccggctcagtcgagcggcctggttaagcccgccccgcccctcccccgaccccctcccctcccgcagctactcccccagccccgggcgcactgcgggccgcggcgggcgctcgggcaggcggagaggacgcgcgcgcgcgtgcgtgtgtgtgtgtgcgcgcgtgtccacgattaccggccgacgggttaaccctttgccgagcagccggtccctttgaggccgggtgctgccggattaatctgccatctgcaaaagaggaataacagggccgtctccgccgactttccctaatgggtaaactgtaccctgttagcgtgacccacgctgcgtccctgctgctgccagggaaagatccggacccttggctcttctgccgcggccctgggtcccctccctgcactgcccttcctctgcacagacacagacacaaggaacagcacgaggggtccaaaggctcccaggggctcgcggtgcagtggacgtgggtgttcccggtgttttctattttggaaactggagaaaggtggggtgggggggacgtagagaaaagccgaggtgggggaggggaggctggtgacagggcacctcgggcttcgctcgctccctctctcgggagagatcgccagctgctctccaacaggcagcgccctgaaatctatttaaagagagggaaaggggaggagaacaaagggggaggagggggacggcgagcggagcctgggcgagagcgagcgagcagggaggatccgccgctccgcgggcacatcaagcgctcacatctgtacactccgcgatcgatggggagaatggataatatttgtcagctgcagacctttctcttcccggttcctggggaggggagggggcgaggagggggaggggcgggcaggccaggcgagagaggccgcctcaaggacagcgcgcttcccgctgcagccacacggaaacccagagccatgaaagccgggggatttttctcttattatcattattaattattttttattattccagagcagccagcgaacgctcggtggcgcccctcccccgccgcctccctttgttgattctcagctgctagagcggcgggcccgagccgccaccgccgcagagcacgatctgctcttgcgccctcggtcgcagctgcggcccaggaagccggggctgcgtccccgccccctgccccccacggcgcggcagccctcgcaccccctcctcgcctcccgccacgaggccagccctgcctctccactgcctctcgctgcggctccgagtccccaacgcagagcagaggcactggctgctgcggccccgagcctccggccgcgcgggggcctttgccaccccctaacccccgcggctgcactctgatgccgccgtcctcacacatggtcttcattttgcacactagcggcgtgcttcctctcagctcctctcctcggggcttttcggagcgaggagggaggtttagaggaagttagaaacccagcgagcccaggggaaagggggaaaaccctcgctcttagtctcagcttccgaggcagagggagcgccccgcggggggtggggcagagtctgggtgccctccccttccttggatgcaggaaaggttaagtgaggggtggcggtcggaggagcgacagatttgcttttgctcatccacatgcctgctcagaccggcctgggtatcactgacccggcactctcggaacggcagaacccggatgggagcagatccgccaagcggtcatcaaacaagaccaaagacatttcagctgtcccccaccctcgggccttgggcgagggtgggggtgccccctgggtctttgcttcctcgcgcaccccaaggttggaaggccaaagccgacgcctcacagaccgggggtccgggccccctctctagggcggaggtgtgcagaaagctctagtgcgagtttacttgcggcctggctaccccctccccccgccgctgtcctgcgattccgggccagcctgcggcggcgtccccgactgctccgcggtcctgggcagggcaggaagctggcacggccgacggctgggcaggcgccacttggccgggcaggctgctcgctggaactcgcgcggcaccttcgcgccgaatcgggttcctgggtctccagcccggtcaccctgagcggtttcaccccccactttgaccatcggcctcccgcggaagtctccctgtctcctcccgccctctcggcttttcccttcctcattctgtctcgggagctccttaatgcagtcaaccgcctttcccgagattcaaaaagaagttttgtgtttccccgggggcagccgcctaatgcttcccttgttttccggaacaaagcagacattcagtgaggagggggcaggcgctgactccctcccctccccgcagcaccccgcactcctgcagattcagaacgctggctccggggcccgggtggcctgggggtggggtggggacccccttcccctaggcttggccacaaaagcctcgcccggtagccggagagaaagcggcgtggtgtttgggtgaggttcccagcccgggcggggagggcgtgcacgcggctgtttacagtgtgcctgtgctgctggaagctcacccgccgccgcttgacagcgtggggcacccgctggctgccagctcagaggagatgcgcagcggcgagccctccagcactccacccgaggcctccgcagcgccagggccagggcgcgctgggaagctccaggtctccaaccccgagttccttcggcccacatacccctccccgtaacaatggcctagatccggtagtatatcaaagggacggggtggggaggggtgaagagcgcacaaggggcgctcagggctgtcgaagcgcctgggttctgagcatatccccgccgccgcctgtccccttgcaggactaaattccccggcccgagtgagcgaaagacaaatactctagtgacttggaggtgtttctctctccggatacccccctgcaaccccaccaacccctacccaccgtgcccagtgaacttctctccaccccaccccgtggggaccgctgcactagctgtgcccacgagcgccaggccttctcgtcggcgcagcgctgccttagatcccgctccacctcttcccctctcctgggcctgtggccggcccctggcgcctccagcgcggcctgaaacttgatctcacgtcgaaaggacagtgtgtaaacaccaggcgcgctccgagaacccacgggaggggccgagcgagggccgccggggcagctcgaggccccgcgcccccgcctgcctgctcgcccgggacacgatcggcggggccgccgtctcgctctctgcctccccagttggctcagctaattggagccgccgccgccgccaccgctgcggcctcttgttgaattttctagatcgcaaccgttcagtcgtggctgcctgtcgctcccctcccccttccacagctgttacctctgccggcaacttggtggtggtggggacccgtccccccgctgaccctggcctcaggctccgagttcaccccagcagttccagggggtgtttttcttcgagacgtgggaagggaggtaaagccttatcggaactgtgaggcttcgtgccagaatccaaggctcgggtactagccagaggatcctcccggcagaaggccatggtcctccctgtcttacaccaggaggtagtgacagtcccggagggaggggctccaggaacaactctgctggcgacttctgttcattccaggaaaacattacagaagggtgaggtgatgggaggcagaaagatcccccctccctcctgcttgccccaatccctgtcagcacttgggcatttgggacttggtgtgtaggttccttctgcagcagagctcacctgcgccttgggcctaatccacccacatgccacaaggatgcttttcctcttggtttggagtacctggtgggtccaggggggaagtgccacccttagtgggttctggaggtacaactcccccatgctgggtcagttctatgcttgtaccaggaggccctcctgggccttggtccttcccagccatccccagccttagcctcctttccccttggccagctgtctcatgccttaaccacacatctgtgctagctgcaaaaggtcccgcctgtatggatctgtaagaggcccagagctcggccccatggttgaggtgggaagatgtgaagcagtttgctagtgcaggaatcatgaagatattgttgatgatggcagagcagttcctggtctccagcattgccttagaatggcttttcctcgtggtagaactttcgctagtgggtttcacaggctcagggcccaatcttgtgaaagtagctacactccccagcccggaaacacataaatacacataggcaaactcccaggaggctgggtgtaggaaccaccaccggggggatctgcagcagccagagaatgtctgcttttcctgtgatggttctgagaagggcgcctgttccctccctttgatggttctctgacaactgttaggtaacaaagagtggaggccacaggctcattaactgtcattttccacctctttcctccgcttctaacttttacccaaattactactttggagttttcctgaggtgttctctccatctatttataactagagcaagatttccaactcaatccttattgatttaaactatgataaaaatgaatccataaaattattattataatttggtgtctaagatgacatttcactaggtcaagttcacacagtttttggcatctaaaatcccccaggcctttccaatcagataacctaagtgtgtttcccactgtcagtttctcttccctttccgtagtggaaaaaaactgaatcctctcaaagatgtttattctccttcactcctaccccatcagtctgtgagaaccttgtttctgtttagggtaaggtatatttctatgttttgataaagaagagagtaatacatgttcctcttcaggcctgaaaagataattatgcatcctgggagcttgctcttctcctggctgtttaacggacaatctggattctggctctggagcaggaatgcttcgatgtcccagtctccttctcgtcccctttcctctgtcaccactcagccatcaccaggcctttaggcgggtcacacggcctgaggatttctgttctgaaggctcagagtgcctcagaagattgcagctcagagcctggtatcatgcattcacatttcttttactgtgcaaagcatattcggagccattgggattcctgttccatctctctgaaagcttatgccaagagctccccatggggcctatggtgatggatgtcatgaggcccaggaaggagccatcatggtgggaagagttgagagcctgcatgtaagactcagactcgaaccaaacctaagtgcaaataacaaggaaaaaaagcaactccgcgcacctggctggtaccctgcttggaaacaaaccgtacctccccaccctcccatctcaaagctagtagagcctaggggcacaccattcctttggcttccctttagcttgacctgggaatggcgcagttaagcatatcaggaagctgagatgcatccactactcctcacttcccctggcgctgggctcagcttggctgaacttgccgttcctgtctttttagaagagctggttgtgttcccgaagcaggatcgcactgtgccgcctccccaggggtccccagctattgatttttaatatccgtattcaatattgtgtattaaacattgaatccatgcacaagaggatgtgatgcaaatcaccagccgtgcctgagactttaatagttgttttattgcccggaaaccacagttggacgcaaggcatcctgcagccgaggctgggggtggggatgacaggctgagaagagagctgagcggagcggagcagagcagaggatacgagatctctgaaatccgcactactgaaggcacagccaggcactaacagctccccccaggcaggctggtggggggccggctccaggctgttgtggaaagagcaggggctgttgtgtgagacccgggcagaggaagaggtgtggggctgtgttcttccttcctggacttccctaactggactgtgcattcctgtccggcagtccttcccctccatgcagatgctcacccagaaacacatacacaacgatggaacaggaaagttaactttggggcaggaaaccccaggcctcgggcctcttccaccactcttcgcgctgtgaccttagcacagacctctctcaacccgctgggccccatttccctcctttgccaatgggggtgatgctatctgtcctacttccctcacagcgctggtggtgaggctgccgcggcacatgagataatattcggggaaaaggcttttgtaaattgtcaggccccacgtaggcaggctgagggattagtgctggctttccctttatactccctctctcctgcaggctgtgtctcctggctgccttctttctcagacatgggcctcctcccccatgaagggccctctcttctgtttcctcggccacctctgcttgatctctcaggcttcctgctctgcctggactctgcattcaggctaggcaatccggtttggaggaggcccagcagggagaaaggaagggtgagaacgactgagtgtgtggtgggggtgagtgcagcaagtgtgtttaaagccaacagcctcgggagggaggagaagcacactcggtagctgcggccctgggttgcggagcccgcgggggtggggccgtgggtggggggcgttgatccgccccgtgtgcggacaagcgggagaagggttgagggaaacctgagtctaggagtgtcttcacgttacactgttgctggttatgggaagtccagcttgaatcccgattgctggaaggctagggtgtgggcagtgccttcagggtattgcaattgcgaaggccaaatggaaatgcggtggaaagtggcagccctccagcgccgccaagtcagataaaaagttgcccgaggccctgagagtggaggcaccagctctctgatggccttgtagacgccctgagaacagtccgagctcctcaaacccgctacctttgtcctgggctcaaggagggggcggaaaccagaggggcccggattcttgaagacctcccctggggaccccactgtctgctgggaaggcctcagccaactgtaggcccaagccctacagagaccagctctggcaggaagtcatgccaagagtctgtgtccgcgtccttaggcgtgagaatggggctatgccaggctgggcctggctgcgcacgcctccgcttcgggactcgggcggctgctgctgccttcgttttcgggtcttcgaccgagcctccctggctctctactcccgctttgtcttgctgtcagcttctcgcctgtcctcgccagtctcctaggtcggcgggtcgcgctctgcctctccgagtgcgtctttgcgcacatgtggcggtcttcctgcaacctgggtcagctcggcctcttcccgcggggtacttggctttgcctttggatcgctgcgagtgtccacttcttgcgctctccttctccccacctcgccttaggcagacgcatcccgggcttggcggtcccccaaacagaaatatccccgggtttctggtttagctccaccaaaacaaactcgagggattggggtatccttcacttgcgtttcccgcttctctcagccctaggccgaaactggagggtttttttgttttgttttgttttaatgagacctactttgcagagttgacggggaacatttctgcggcagacttcgaggtctgtggcgctctcccaactttcaagactgtaagccgccaagaaagagaatttgggtacatgattttgccgctgatgtgggctgggacgagggtatccagagtgcacgtgcatgtgcggatcgcagggactctcggtggattagccgccaaaagctggggagcgccgcgtatggacgctagggctgggggccagcggggacctacaaacaccccaggcggccgagcaggtgaaggaaacgttccgagcccgccccctcctcccgggcccgcacgccgccggcctttgcggcggaaacacggtccaactccttgaaagtaaacttgccgccaggggctaggggcgcgaagaaaggagggggctgacagcggtgtctgcgtcggggaggccaggaaggcttgtgtcaaatttcagcccccaatgacactcggtggcgaggtgccaaggccctgggaacggcggcgggggttctgggtgagagtgatcgcgccgcagggcccagcttgcgaaccccgaggcgcccgcagggcctagggaggccacgggggcgggcgcggcgggcggggagggggcgctcctagagcctcctgagcggagcggacgcaggcatcttccgcaatccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcagtcctcttccaggggcttgtgttgcgcccttctcgcttgtttgtctcgtgtgagcctcgtaaaccgccttgatttattacccagactaaatgcttaatttgtgaatatgaaacagattaaaaggggcggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcatgtgtctttggtcaggtccccgcaatgatccacctaacaaaggcctctcctgagtaccctctccctttgaataccccacatgtatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacctgatactgcagtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcccgatctcgactcactgcaacctctgcctcctgggttcaagcgattctcctgtgtcagcctcccgagtagctgggattaccaggcacgcgccaccaggcccggctaattttttgtatttttagtagagacggggtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaatcaaggagaaatggaaatcgggaaaaaaatccatagcccacacatacctgaacagggcctatgtcaccacagagcaggagggaggtctgctgtagctccagacagtgttggctgcagaaaaatgactcaggtgcccttgtggcatcggagttattgctcatgtgccacggccccctcacgcacaggagctggagctgtataaatggccgtggggacagaaaggaacagatgtgtcaagagtccaaggactaggtgtgtgttgtaaagccaaacagatggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctcagtgtgatcacaggtgcccttcctcaagccatctggcctgggcccagcctctgctcttggtttccctaagcagaggcgaaacacgctggaaccttcaaagcacattcctaaacactaagagagagctgtggggaagtgaaaacaaagaggccaaggagcgctggagcagttcagcttccagagtctgtgggccaacagggctggctcaagttcagtcagacttactggccctgggccaaccagagctggcagcgtgccctcttcagcccactgctcaggccccgtcgccccccaaaaacctgggcacaccccagagcaagcccaagccccaggaagccctgctgccccttggcagccctctcagaccaccccctcccccttctagttgtgggttgctagttccagagccagggaatggcttccaaaatcccttcacccagagcttcccaagagtgagtgggttgccaatgggtcaagacggggatcccccagcccctcagagtgaaccaggggtgacccaattccttggctggcagcttcaggccatgttgggcaattgtggacactcggtcactgtttaactttgtgcaacagaaaaatatcacattctgtgctgagaatcactgctcacttgtcataagtgtggcatccatgctccaagagttacccacacatacgaataggaaggatattggaccacatggtccttcgtggatggtgaacacagcatagtcagtgattcaactagcattcgttcaagcctctcttgtctgtcctgcactgtgcttgtggctgttggggtggctcggggaaacccccggttaacaagacccaggcccctccttagagaacataaagtctccccaagagagataagccccatggagctgaaaacttcattgtgcttacactaaaaccaggagaaagagcaatccctggtattactcctcaggcatagttttttggtttttttgtttgtttgtttgtttgttttaaatggggtctccatctatctcttgctgaggctgtagtgcagtgaggtgatcacagctcactgcatcctcgacctcccaggctcaagtgcttctcctgcctcagcctcccgagtaggtgggactacaggcatgtgccaccacagctggatcatttttcttttttttttttttgtagagactgggtctcaccatgttgcccaggctggtctcgaactcctgggctcaagtgatcctcccgcctcggcctcccaaagtgctgggattacagccgtgagccactgcaccccgcttaggtatatatatattttttaagccaaaggtctgatggtgtgtttctgcccactttacacataaagctgggaaactaaagactccctcatactcccagcagctgacctgctgaatgggacttgggagctgggaattccgtgctttctctccaaagggtccgcccaggtgacatcaagttcatggcagatgttatgggtaacacctgcacttggcagaaaattctaaggctataaaaggatgtttggtgcctctcccacccgcatttctcagtcactcagtttgcctctctgaaggcaaccagtgctcccagtttattgcttactcttcccaagatagtctattaaggctgattttttttttttttttgagacagtctcgctctgtcacccaggctggagcgcagtggcacgatcttggctcaccgcaatctctgcctacctggttcaagcgattctcctgcctcagccttccgagtagctgggattacaggcgtgtgccacgacgctgggctaattttttgtatttttagtagagacagggtttcaccgtgttagctaggatggtctctatctcctgacctcgtgatccacccaccttggcctcccaaagtgctgggattataggcgtcagccactgcgcctggcctattaaggctgatgcttaaaaaaaaaaaaaaatatatatatatatatatatatatatatatatatatatatatgtatatatattatatatatatatatatatatgtatatatattatatatatatatatatatatgtatatatattatatatatatatatattttaaattttattttgaaaaaaatcccaaacccacagaaaacttgaaagagcagtacaatgaacacccatatatgaaggcaggttttcaaaagcattatatttattcaacacgcctacccttggaaagaattcaaaaccccttcaaaggtctgaattagtttaactttatcttaaactgttacttaggagtacttttccctcatagacatgttgcctgcttgttcatccccctcctcccagcccccagcaccttattagtgtgcctcgtgcatagtgggcatttcctaaagcttgcaggattaaatagcgaagactatgtcgtagttagtatgggggagccagactgtctgggttcaaaacctggctctacaacttgaccagctgtgtgacctgaggcagttactctcgccaccttacttcccccatctgtgaaatggagggtagtgatacaatatatttaatgatgttgggaggattagttgatggacataaagcatgtaaaatagtgcctgggccagacacggtgtctcacgcctgtaatcctagcactttgggaggccaaggcgagcagatcacctgaggtaaggagttcaacagcagcctgaccaacatggcgaaaccccgtctctactaaaaatacaaaaattaggcaggcgtggtggtgggtgcctgtaaccccagctactcgggaggctgaggcaggagaatcgcttgaacccgggaggcggaggttgcaatgagccgagatcgtgccactacactcctgcctgggtgacagagcaagattccgtctcaaaataaataaataaataaataataaaatagtgcctggcatctagaaagtgcttaataggtgttagggacacttgagacttaaacacacttggtattaactttgctttggtgattgcatgtaagtcatttggccgagttgatggcctccgagttttccttggtaaccatgagagagacccaagaaaaccgggaatgtggcttcgtagtcgtccctcgcctgagaggattgcctacgctcagcacataagtagcaggggcttcttgtgaccagtttccactcatggagagtttctagctgtgcttattaaaaagatatttgaggccgggagtggtgactcacgcctgtaatcccagcactttgggaggccaaggcgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccatctttgaagaaagagctagcatttgttttacccacagaccggtaagatcttctctctcagggtgaagcctaggctcacaaaagcctgagatcagaaagtcaagggttagagagagcaagtaggtgcaaccccagaaacctccactgtctggcaagccagagagtcttggggccccccaacagacaaagttgtctggaattttcttcacataggaagtgtagaatggtagatgtcttaagagccagaggcaagagaggactggggaaagataaaggaatttgtttattttattttatattttattttattttattttattttattttatttttgagatggagtctcactctattatctaggctgcagtgcaatagctccatatcggctcactgcaacctccgcctcctgggttcaagtgattctccagcctcagcctcccaagtagctgggattacaggtgtgtgccaccacacgtgacaatttttgtatttttttagtagagacggggtttcaccatgttggccaggctggtctcgaactcccaacctcaggtgatctacctgccttggcctcccaaagtgctgggattacaggcgtgagtcaccgtgcccggccaggaatttgtttaaaggtatactctgtgctataaaatactgcacctaatgttaggctttgacggctataatatctgactttgacattgaggtgtatctgccatataatttaattaacgtgtgatgccggcacaatgccagagagtcaaacattctgacagctcttggaagccacataagtccctttgaagttccccccagtgaagtgacacacagagaaacctcctatggttgaggacagcccctgatacggtatccagaaatttagctgcgtcttggttatattggatggcactggcaaagccacctgctggtttgccacagttctggaggtctgctgtggtttctaagggccccaaccatggagactggctctttggggaagaagaactcattcttcatcagggacaaaattgggaggtctcctgtttgcatattttgttctacaaaatgtttttttcttcctcaactttgcttagtgcaaagtcattgagctgcacacaggaacgtaaattaggtaagaggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttttctcaaaaaaaaaaaaagaaaagaaggaaaagaaaaaagccatgatggaatggagacctttcttcctacaggggtttcccttgcaggaaaggtacaggtgggaaagctcagaggagaccccagaccgagcaagtttccttgcttacctctaagcatgtcttggagatgtggcataggatccaggaggtgtgactaaaagctagacttttagccagtctcgcaggctgtgcaggacacaccttcatctgttgtatgaaggtatatgagctggccaaagattcgcgttcttccttgcagctccttttccccccagttctgcccacctttctcttgctgtccttgaataatgtgggggggattcctaagtgtctctgcagaaagtgatgatttctaattttgggcctcctttcaatgaattcctccagggctctgcagtcagccaagtactggaacctagcccttccctttaggaaggaaagctcttggttcaattgattccgatggttaatggaatctcatcaccgttgcccagagtggttctaatcaaaggaatccactgtctaaaaattcaaggtagcagcatcaaggtttacatcttgtaagcaaagagactggggcactggggcagatatgttttatggtggagccccatggggattcagtctcttatttgggagaattctggctcctggctccaaaggtgtgtgagttgatccatcttctgtaactaatcctagcctggacttggaagggggactgccttttttattttttggtgtttggtttttgagacagggtctcattctgtcacccaggctggaatgcagtggtgtgatcatggctcactgcagcctcaacctcctgggctcaagtgatcctcccacctcagcctcccaagaagctgggaccacaggtgtgcgccactacacccagccaattttttatttttagtagagacaaggtctcattatgttgctcaggctggtcttgaactcctgggctcaagccatcctcccgcctcagcctcccaaagtactgggattacaagtgtgagccaccacgcctgaccatgtccttgatctgtaaatgacagtagcttttggaaactgagaaaataaaaatctggatcagacttcaagtcccctgacccctctctgatctggtcctcgtcttcccctctcctctggttccacagctgccacagagcacacccctggggcagcccagtgagtccctctacccattcatgccctcctgcttgttctgccctgggagggagcctcagcccctgagccccctgcctggagtgatccccctgctcaccctgactcccagctccaggccccacctcctctgcggagcccctcccaaatttctagggggttacatttcagtctaattctcccagatgcctttgtgcttattgtcacagccacaaaacttatcatttggttgctctgaaatgactttacgccttatctcctcgcttcagttgtaagttcttagagcacagggaccacagagcctagcaaggtgttaatacacatgagtgtacttactggttggatagcctcccatcaatttctgtctcttagtggtgtgggagtagaaaagactccccagatgttagggccaagaaggttgaaattgaggccgggcgcggtggctcacgcctgtaatcccagcactttgggaggccgaggcgggcagagcacgaggtcaggagattgagaccatcctggctagtacagtgaaaccccgtctctactaaaaatacaaaaaaattagccgggcgtggtggccgtcgcctgtagtcccagctatgcggcaggctgaggcaagagaatggcatgaacccgggaggcggagcttgcagtgagccgaggtagcgccactgcactccagcctgggcgacagagcgagactccgtctccaaaaagaaaaaaaaaaaaaaaaagttgaaattgaagtagatggccgggggcggtggctcacgcctgtaatcccagcacttcgggaggccgaggagggtggatcacgaggtcaggagttcgagaccagcctgaccaacatggtgaaaccctgtctctactaaaaatacaaaaatgagccaggtgtggtggcatgtgcctgtaatcccagccactcaggaggctgaggcagcagaatcacttgaacccaggtggcggaggttgcagtgagctgagatcatgccactgcactccagtctgggcgacagagcgagactccatctcaaaaaaaaaaaaaaaagaaaaaaagaaaaaaaagaaattgaagcagatgagctcagatcatgagggattttctgaaactgctatattttgaagaaaaccttgctggtcccctccagttttctgtaataacctggctgagcagtgggtttcactgtccggttcacgcactaactgcttcagggtcacctggggtgccagttcagaattcagagtcctggccccacgcctgaaaatactgactcactaggcctggggtggggcctggaaatctctatctttaacacgccactgctgactctgacgcacagccaggtttggaaactagtcgagtctgaaaagaatgttctcttcttggaagtgagaaaatgttaggggggcaccgtgagaaggggctatgatttggattctgagagaccaggtttgagtctcagttctgccacttaccaggtgtgtgaccatgggcaagttattcagcccctctgcacctcagtttcaagtgggaacaccacggatctgttttgtgactagtgccatgcaacaaattaccccagaactttgccacttaaaacaactctttggccgggtttggtggctcatgcctgtaatcccagcactttgggaggccgaagcgggtaggtcaattgagcctaggagttggagaccagcctgggcaacatggggagaccctgtctctacaaaaatacaaaaattagggtgagaggattccttgagctctggaggtcgaggctgtggtgagctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgtttttctcagtttctagtcatttctagtccttttggatagtaaatgcagggtgcagtgagcaccttctcattctgaccagctcagctctctcaggaggttgggactgcaagatctgtggttcactgtcacccccatatcagccttacccatgtgcctgatctcaagtgcaagctcactgggctccgaatgggaacacctggctgagtactgagtgttttcaggtcagacaacctggtttggggcccaggagggtcatctgttgcaatggtggcctgaggggcagctggagagaaagagagcagctttggttggcgtgggtcttctgtctcacggtcatgagtgggccccttctctgaccttgctttcttcacctcaggtctggagacagtggaggagctgaggaaaggtcacatggagaccactggggccagcaagccagctccccagggaaggtggggggtggcttgcatgacagatgcctcaggatgaggggcattaagagggtggctgggttccaggggctgccagagtgggtaggatttgccaaatagggtacccttggaaggcaggacacaagagggaggagccattatgtgcctgctgcaattcactggcatttgtggagggggtcgtttgcccctctggcccacacccttattcctgaaaaaggcagttgggcctgtgtttagcactccgaggaacctgctctctctggtcctcttcttttccttctggggctcctgaacctccccaccgacatgcttccctcattaccaccaagcctcacatgcagcagctgccttgctgagagcagacaggggtaggcttggagctgcacagcgatgcgacacatgatggggctccttctatgtgccccacacctagccaagggctaaaaatggtcacacgtctccatgatctcattgacgaactcacaccatgggcctgaaggagtgatgtgtgagtcagcaccccggaatccctggcagagcgggtcttggaggaccaggaagaccaggggaaacctcccagattgagtcattaggataggtcatagtgcaggctgccctcccctcagtctccatgcctcagtttcctcacctgtaaaaggagagtaactaagtgcccacctcatagtgtgaccacaaggagggaattggggtgcacccttaatcaggctgctctccacctgttgaagatttagatgaagagggacagggaaggagggcaggtgcatagggagttgctggggcaggggaggcagagtcatggaggagaaggcccggagggtggtagaggaggtgcctgctgcacgggtgaagtctgttcttcttcttttttttctttttggatggagtctcgctctgttgcccaggctggagtgcagtggcatgatcttggctcactggttcatacaattctcgtgcctcagcctcccaagtagctaggactacaggtgtgcgccaccacgcccagctaatttttgtatttttggtagagacggggtttcgtcatgttgtccaggctggtctcgaactccggacctcaagctatccgcttgcctcagcctcccacgcctgctgggtttacaggcgtgagccaccgcacccggcaaggagtctgttcttagaggcagagccaccactcctgctcccaaggaaaggacagtgaaacagctttcgcccataccccaacccccacctccctaaggccccgcagctcctccctccctccgtctggactgtttccccttctccctaagacatttcctggaagctctgcccacagttcttccttctacttatatacctggcctggccccagccctgccactgaggcctggcccccccattatgtgaccagcttttcctcttcttctttttttttttttgagacggagtctcactgtcgccaggctggagtgcagtgacatgatcttggctcactgcaacctctgcctcctgagttcaagtgatcctcctgcctcagcctcccgagtagctgggactacaggcacgtgccaacatacccagctaatttttgtatttttagtagagacggggtttcaccattttggccaggatggtctcgatctcttgacctcgtgatctgcccgcctcagcctcccaaagtgctaggattataggcgtgagccaccatgcccggctaacttttcctgtttctactcacttgggctgagatccccgttctcctatgtcaccttccttaaacatcacaccttggctaagaggaaagactgtccatttgggagtctatgcccactagctctgcgacctcaggagagccgcttaacctctctgagtctcagcttcatcatgtgcaaaatagggtcatttagttgtgactagtgcctcattttgaccgtacttccatgaggattgaataagggaatgcattgaatatgcaacaagtacatagtaggtacttaataaatggcagctatttccatggtgattctaggcctgtgtatccagagagtatttgactaatagacatctgcacgcctgtaatcccagctactccagaggctgaggcgggaggattgcttgaggctgggagtttgacaccagcctgggcaacatagttttttacaaaaagccatctgagggtatgacttgcatagggagccacttattattggagggcagataaagaaaaggaggtattcctttctttcccctgatgattcaggcaaggtggtccctgctcccttttatttcctgagttacatctatgctgtgccctagaattggaatcagtaagcacagatgccattggagtttttccccaatattcttttttttggagacagggtctcactctgttgcccaggctagagtgcggtggcgtgatctgggctcactgcaacctctgctttccgggttcaagcgattctccagcctcagcgtcccaagtcgctgggatcacaggtgtgtgccaccaagccgagctaatttttgtattttttgtagagacggggttttgccatgttggccaggctggtctcaaactcctgagctcaaatgatctgcccgcctcggcctcccaaagtgctgggattacagctgtgagccgctgcacctggcttctaacccaatatacttttttgtttttttgtttgttttttagaaggagtctcactctgttgcccaggctggagttcggtggtgtgatctcagctcactacaacttcctccttccgggttcaagagattctcctgcctcaggcacccaagtagctgggactacaggtgcatgccaccactcccggctaatatttgtatttttagtagagatggggtttcaccatattggccaggctggtcttgaactcctgatctcgtgatctgtccgcctcggcctcccaaagtgctgggattacaggcgtgagccacagcgctcggcctcttccccagtattcttgctgccttttttttttaaatttatttatttatttatttatttatttatttatttatttatttattttgagacaaggttttgctctggagcgcagtggcatgatcatagctcactgcagcatcaaattcctgggcttaagtgatcctcccacctcagcctcctcagtagctgggactgcaggtgagagccaccactcctggccagattttaattttttttttttaagacagggtctcactatgttgcccaggctggtgtcgaactcctgggctcaagtgattatcctgcctcagcctcccaaagttctaggatcacaggtgtgagccactgcctagtcaacagacttgcttctaagacttttggatggaaactcttctagagtatatttcaatgagatatatcagtttgctattgctatgtaacaaaacactctaaaccatagtagcttaaagcaacaatttcttcttctatcacaattgggtaagttggctgggctgttcctctgctggttacatctgggtttactcatgcagctgcagtcagctagccaacagctgtggggagatccaagatggcctcatgaacagtgtggcagttggtgccagctgtcagctgcagtgaactgtcactcttctccctgtggcctcacatcctcaagtatgtgagactggcttccttacgtggcagcctcagaactgcctgagagggtgaagcaggaagctacaaagtctcttaaggcttctcctcagaagtcacacagtgtcacttctggtgcattctattggtcagagcaagtcatgatgccaactcagatcctcgaggaagagatggagattccaccctagattagtctgctggggctgccataacaaagtaacatacactgggtgactcaaacaactgaaatatattgtcttactgttctggaggctgcaagtccaagaacaagttgtcagcagggttggttccttctgagatctctctccttggcttgaagatggccaccttctttgttgtgtcttcacatgttcttcccaatgtgtgtgtgtgtgtgtgtcctaacctcctcttttttttttttttctttttctttgagacaggctggagtgcagtggtgccatctcagctcgctgcaacctccacctctcaggctcaagcaatcctcccatctcagcctcctgggtagctgggaccacaggcgcacgccaccatacccggctaatttttgtattttcagtagagacagggtttcgccatgttgaccaggctggtctcaaactcttgggctcaagccatctgcccaccttggcctcccaaagtgcgagccactgtgcccagccagatgattcttttttgttgttgttttcgtggttttttttcttttcttttctttttttttttttttgacggaattttgccttgttgcccgagctggagtgcaatggcacgatctcggctcactgcaacctctgcctcccaggttcaaacgattctcctgccttaggcacccaagtagctgggattacaggcatgcaccaccatacccagctaattttttgtatttttagtagaagtggggtttcactctgttagccaggctggtctcgatctcccgacctcaggtgatccgcccaccttggcctcccaaactgctgggattacaggtgtgagccaccacccagccccagatgattcttttttttttttttttttgagacggagtctcgctctgtcgccaggctggagtgcagtggcacgatcttggctcactgcaacctccgcctcccaggttcaagcgattctcctgcctcagcctcccgagtagctgggactacaggcacgcaccaccacgcccagctaatttttgtatttttttttttagtagagacggggtttcaccatgttggccaggatggtctcaatctctcgacctcgtgatccgcccgcctcggcctcccaaagtgctgggattacaggcgtgagccaccgcgcctggccgactcccagatgattctttagtgacttcttctgtctgcctggaggctgtgagacatgtgccctctaggcttgccattaacttctgtgaacacactcagctgtgacagctctgagggaactcacccacccccatattagttatctaatgctgcataacaagttgcccaaaaatgtagtggcataaaccaacaataacaatgtattctatctcttgatttctgtgggtcaggaattcagataaagtacagcagggatggattgtctctgctcacaatgtttggggcttcaggtggaggagttgaagctgggatgctggatgatacatttccatggtggctcactcacttggttgggcgtgagggaggaaaaatgtagtgattagaagagactgaagaggtccagatgtggtggctcatgcctgtaatcacagcactttgggaggtcgaggcagatggatcacttgaggtcaagagttcaagaccagcctggccaacatggtgaaaccccgtctctagtaaaaatacaaaaattagccaggcgtggtggtgtgcacctgtagtcccagctactagggaggctgaggcgggagaatcacttgaatccaggagacaaaggttgacttgagctgagatctcgccactgcactccagcctgggtgacagagtgagactccacagtcaatttctcccataatcaaccaccttctccaggcagctgctggagctgctgccccaatgcatcacttcctggcacatagcaggctgcagggaccacctcatctgcctttgccacctctcttcccacttgttcagctgcccttgagcagactggatggccttccagaacaggacaaagcaggctggccacgtgtgcttttatgccctcctccccaacccgcccccccgacgccacacacacccctccatcctctgtctgacccaacactccccacaagatgcctagaatgtctttcccagggcggcctcccttaagggtatgtcttacttattttcatagctctgtacatatatgtaaggggtgtttcagaagggtttgtgggccagtcacagtggccctgtaatcctagcactttgggaggctgaagcaggtggatcacttgaacccaggaatttgagaaaatacaaaaaataccaaaaaattagccaggtggtggtggtgtgtgcctgtagtcccagcgactcgggagactgaggtgggaggattggttgagcccgggaggtcaagtctgcagtgggccatgatctcgccactgaattccagcctgggtgacagagtgagacccccctctcaaaaagaagtgtttgtggaatagaattgattttaaaacctttttaaaaaattgtaagggctaggtgccgtggctcacgtgtgtaatcccagcactttgggaagccgatgtgggcggatcactcgagcccaggagtttcagacaacatgacaaaatcccgtctctacaaaaaataagaaaattagccaggcatggtgatgcatgcctgtagtctcagctacttgggaggctgaggcgggaggattgcttgagcccaggaggtgaaggttgtagtgagccaagatcgtgccactgcactccagcctgggtgacagagtgagatgctgtctcaaagaaaaaaaaaaatgtatatagagatggggtcttgctatgtttcccaggctggttgtgaactcttgacctcaagcgatcctcctgcttcagcctcccaaagcactgggattataggcatgagccaccctgcctgaccaatagttcaaaatctttatggtccgcttaagtccgtagttcaccatattcccctgagttctctcaattcccaaagttgcaaagaggccagtggggattctgaaggtttctcctatcagcttctctggtgctcattctcccgctcccaagggccctggccttttcccaggattcattacatggtggccctttctcaccatgtggcatccttaaaagcatggggtttgaacattcagcctgagttttgcttgctatggattggtggaatggtagtgctgggagagaggaaacatttctgcttcctctgaaccctcttatgcgtgcgcgcgtgcacacacacacacacacacacacacaaccaggaaaccttctcttcccctagcccacgtctcctcccagtctgtgctcttgcacttccagagccagataaatggaggaaaaacacagctgcagatgtagccaccccaagagaaatcagaaagtgtggaagaaaaaaagaaggccgggcgcggtggctcacacctgtaatcccagcactttgggaggccgaggcgggcggatcacaaggtcaggagttccatatcagcctggacaatatggtgaaaccccgtctctactaaaaatacaaaaaacttagccgggcatggtgatgcatgcctgtaatcccagctactcgggaggctgaggcaggagaatcgcttgaacccgggaggcggaggttgcagtgagccgaggccgcaccattgcactccagtctgggtgacaagagtgaaactgtctcaaaaaaaaaaagtgtgcttaagtgactgctgtacccctactgactatacaccaccctcccctccatattgctctgttggagggtccctaagaccccttctcaatccttgttctcactccctgccactgcacacagagcttgatggcaagccgaatatggtatctccttgaaagtgagagaaacagttgcatttagaaggggaattcacctagcaggttaaggaaatggcccaaatggagatctctaatccccatgcctgtttttaagttgccatttgacccacagtggacatctctacaggaaggccagtaagtgcccgagactcccaggcctccgagctgccccagggcccaggaacgaggtcagatgtgataacggctctgatgtggccaaaagcttccatcatgctaagcagttccaaacagtcccgctcgtcaggcaggcccggggcagtggtgggtagcgacagtgtgatgctcggccttgcccccaaagcttaagcctttgatggcaaaagcacactcggctctgtactgagctgactgcctgaaaatattatagaaaacatctctcccttggcggggagagatctaagccccagtgaccggggagtttaaattttcgggatgggtgaccgaaggctgctaagaatatccagtcacaggcctgaccacaagccagttaacgccccgagtggcggcttccatggtccttggggcatgggaagaaggagccgactgggcagccagtacttgtggagtccctcagcaggaattgtgcagacacaaagtaaggagtaaaataacattaaagaaaaccaaccacctgatcgtgccctcaaggaataatctgagaagggaagacattgacctaccatggggtacttactgtgcgttaacagatcaaaacaaggacaaccatgcagaagggaacagtctccgagacaccaagtgccaacaagggaccccaggctggcttcccacagccagatggggtagttcttgtggcctggcagctggcagcctgacagaaagtcaggtaggcccagggtacacattctaccctctagccctcagtttcctcatctgcagagtgaggggtttgggagtcctgtttcgtcaacattttgggtgtctgaggccctctgggactctgatgcatgtacccctggcaaagtggacatgtgcacgagggccaccattttcacagcatttccaggggtgtccggccccaagtagaccagccccagatctcaagtgagggctctgaggtttttgtatagaggagagactgttcttggagggctggaagtggctgggaagagttcatggagaaagcaggatcgaagtttgggcagaaatgagatggctacaccttcattcaatgaatgccatgagcttcaacggtcagcaagcccaagggatggatgcgatgacaaagagaccagagaggatctggaatcgtgtgcagcaccgtttccagctggagagagagagcccattctgctccagccatgtgggctgtccttctcttcctcaggtggtccaaggttggtcctccttcagggcctgtgcacttgttgctcggctacctgaaactctctttcccccatactcatgcagctggttccttctcagctcaatttttcaaagaggcctcccaagccatcctggctaacactgccttccctcccactactctcagccacactgctctgtttcatcttctgtgtggcacatgtcatcatctaaagttaccttatttgctctgtttatggtccatctcccataggataaggaccttgtcagtcctgttctccacggtgccctggcacccaggacagtgcttggcacagagtaaacaactgccaaatttgcaatgaaccaaatgaagtaattatagccttaacgctagatggctgtgcactggggaggcctgtggcgtagaggaagggcagggtggtttgagagggtgaggctgagccactaaactggtctggatgactgtttggggaaggtatcttggaggaagtgctgtttgaacagagttgtgaatgactaagtgaagcgggtggagggatcgcaaatctaagccagctcccggtggcaacggctggatgtgggaaggggctggaaacagaagcccagagccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctgggccatgcctagggctgccatgatgaagtgctgccaagcctccaatacggcacatctgcctggcgcatcactctcaccccgctcctccccccgccccaactgtggagcagtaagtttgcttctattcacgtgattttattaacaaaatttgcttccttgctgtctctagaagcagcacactgccctcccccaaccccccaacttggctcagagcaaccccacactcctgctatcaggtcatctgcccagagtgtgattgcagttttaaaactgattcctccctggtttattatttttttttagtttctattttttattttctggaagtacagcacacagacagaaaagtgtacaaatcctgagagtacagcttgatgaattttaacacacccatgtaaccagcttccagatcaacctgcagtgttcccagcccccaaggagtcccactgtgctccccatctccaaggataactccatcttgactcctcttcttttttttaatgagacagagtctcactctgtcacccaggctggagtgcagtgctgtgatcacagctcactgcggcctcagcctcctgagtagctgagactacagcacgcccaccacacccagcttatttttgtagtttgtgtagagatggggtttcaccatgttgcccaggcagggcttgaactcctgggctcaagcgatccacccacctctgcctcctaaagtgctgggattacaggagcaagccactgcacctggcccatcctgacttataacaactcagattaaaacctttgcccactttaaaacttgacataggcaaagcgccactgcactttagcctaggtgacagagtgagaccctgtccaccccccaccggcaccaccaccaaaaaaaaaaaaaaaaacaacacccaaactagatgtaaatggaatcctattgtgcatattcttttgaggctggcttcttttcatttgcaaggtgttgtgtgtgcttgcatcttaaaaaacagagtctcaggccaagggtgatggctcatgcctgtaatcccagcacttcgggaggccaaggtgggcagatcacctgagctgaggagtttgagaccagcctggccaacatggcaaaaccctgtctctactaaaaatacaaaaattagctgggcgtggtggcgcatgcctgtaatcccagctactcgggaggctgaggcaggagaatggcttcaacccaggaggcagagattgcagtgagccaagatcgcactactgcactctagcctgggcaacagagcgagcctccgtctcaacaacaacaaaaacagagtctcccaagcagcctcccacctgaggcaagggatcagggcccagtctcaggaggcccctgtagcctgtggaatactcagtagaggaactagggggtcagtggagactttgtgtggggcagaggacagcattggtgttttaagcaaatgacatgctaagcattgtgttagatgctgcctggatacaaaagtggaagatgcggttaagagggggtgaagggaagataagactggatctagagtcggccaggttgtaagaatgtcttgggctgggcacagtggctcacacctataattccagcactttgggaggccgagacgggtggatcacctgaggtcaggagttcgagaccagcctggataacatggcaaaaccccatctctactaaaaatacaaaaaaaaattagccaggtgcggcggtgggcgcctgtaatcccagctactcaggaggctgaggcaggagagtcacttgaacctgggaggcggaggttgcagtgagctgagatcgcgccactgcacaacagcctgggggataagagcaaaactctgtctcagaaaaaaataaataaaataaataaaagaatgtcttgaactgcaagaagaggaaagaaagtgaaagctcacacctgaggggaggacagaaaggtcagaagggttgtgactccccgcctcccaaaaagatcccctcagtgctacccttaaagtcactttcctgaaagggggggtccttgccttgggggaggagacaatttcagttctattatctcagtcatccagaaagacttctctgtgcctgtggtgtgttagagagaagacagatagggagggaggaaaaggggtggggggggtggagagagagagagagagagagaaagagtgcgagcatagtatacttcctgggaaactatctctcgaatagtagttctaggaagcctcatgccagagggcagtagtactggcctctgccttcttgatggtgcccttggacgtcagaaagaggaggaagcctcagggattggcagagacatttgagagtttcagaagctgaagtccagagagggtgagcgacttgcccaaggtcacacaccaagaaagcaagcattagaaaggggatcgagtgtcccctccatggtttttccatgatcgtgtaccaccctttcactttacaaagagcctagtgttgccaccaaaatagctgaattacctcatttttgaaaggcgttatgaattcacttctattatgtggaatggggcagagatgttgtgagcaggcatgacattataattcatattccacttcttctatttatctttgctgggttttgtgtatctttggaagcagccttaaatcattattggaacaaagtagggagaaaaataataatatgtaattacaaatgaggaatagaccgtatgatcctattaattgccttccctgcaatctttatttttggtattttcagaataattaacggcttaggtctcgattggtggaggtggtgggttagcactgaactctaaacagtaacatcacctactccaggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcactgggattacaggcgtgagccaccgcgcccagccatataggacagttttctatatgacatgagattattaatgtgtataaaatgtttagaactgtgcctggcagatagaaagcccttaataaattctagctattgttcttctaggagctgaagaacattagtgactctcttttcctcaaatcccaagagctcttctgcttcagaagagctgtgtgatgagttcttcccatgttatcccttcgtgaactaccttttcccatggtaaggacaagagtagtctttatggaagctcaaaacggggaaaagtgttgcccaggaatatgaaagggcaaggtagcttataatctcgccagacattgagccataatttagtattggtggaggtacaggtatttttcaaacagaatctatttgttctggggaggaagtccttcccttgaacatcttggccccacacttttttttttttttttgagacacagtcacactctgtcacccaggctggagtgcagtggtgcgatctcggctcactagagtttccgcctcctgggttcaagcgattcttgtgcttcagcctcctgaatagctgggatcacaggcgtgcaccaccacacccagctaatttttttatttttagtagaggcgaggtttacgccatgttggctaggctggtcttgaactcctgacctcaagcgatccgcctacttccacctcccaaagtgctgggattacaggcgtgagccaccgagcccaggccggccccacactttttcaaggcttacctggaaggaaggcaactcttcattcagatgatcaattcttaggttcccatggtgaacacaacagatgagctgaggcctgctgatcccagaaagaaagaaactccttttatgatacttactgcagttggcgagttgccaggatgggcccagaaggatgcaattgcagaagctatgtaggatctggtcccagaaatagttaaaggtttggggaaacagtgcatatgcatgacagacaaacaatataccctatgggaaagagcctaggtttggagtcaggtagaatccccgtagccacactctcctagattagccatgtgttttggcgcagtggctcacgcctgtaatcccagcactttgggaggccgaggtgggcagatcacaaggtcaagagattgagaccatcctggctaacacaatgaaaccccgtctctactaaaaatacaaaaaattagtcgggcgtggtggcaggtgactgtagtcccagctacatgagaggctgaggcaggagaatggcatgaacccgggaggtggagcgtgcagtgagccgagatctcaccactgcactccagcctgggcgacacagtgagactccaactcaaaaaaaaaaaaaaaaaaaaagtgaatggtaatacctaagccatagggttattttggggtgtgagtgagataacttggaaaagtacctgataaagtaactgaaatgaacaaaggtccttaataaacagtagctatttttatcacataggaattattcattgttaaaagacttgctttgctatcaaaaacagcgcagggacacagttactgttagaggtcaaatggcatggaattcagagaactccaattgcccagggtcagctgtgagaagaacctacacttctggtttcttagggtctcaaggagaaagacagtctcaatcttctgccactaagttaaggaccaaatgattggcaataggcaaagtactctaagaaggctctggtttgggttttgtcttccttttggctttctcatctcctggggatgatattctgcaggacttagttaaggacaggactcccaaggcctccccaccagcatgcacaccaggtcacttggctcctccagccgacagagacctgtacacaggtgtcccatactcccacgggcctccccaaaagacagtgtctcccccagccttatgcttcactttcctaatttcttctgccccaatcctcaccagaactacagagccactccccaccagtccaggtaccccctttcctatagcaccctctccacaactgtcttgttctcttgaacctggtttcttctctagccaggatatagaataccgattcagttagcaaaaatgtattaagtggctggctacagtggctcacgcactttgggaggctgaggtgggcagatcacctgaggtcaggagttcgagaccagcctggccaacatggtgaaaccctgtctctactaaaaacacaaaaagtagccaggcttggtggcacacacctgtaatcccagctactcaggagaccaaggcagcagaatcacttgaacccgggtggcagagattgcagtgagctgagatcgtgctgctgcattccagcctgggtaacagagtgagactctatctcaaaaaaaaaagaaagaaagaaagaaaaaaaaagtattaggcatgcaatacttcatttattgtttatcagatttttttttcatcaatatgtggtgagcaccatgctaggcactgggcacatacagccagaaacaaaattctgagaacattatggatatatgtacatcgctgcacactgatgcaagcttagcacctggtgatgatacactgtaccattatggacgatacggtcttgctgagggaggtgacctcccagggaccaacccgcagagcctattcaggagctgatagcaggcctgtgtggttggccttcagagggtgagctaaacactggcaagcaatgaagtggccttgttaaggcatttagattttgttctaagtgcagtgggaactagtggggtagtgacattcaacactttttttttttttttgagacatggtctccctctgtcacccaggctggagtgcaatggtgcaatcatggctcactgcagtctggaccttccagggttaagcaatcctcccacctcagcctcctgagtagctgggactacaggcgtgcaccaccacacttgactactctttttttttaagtggagatgaggtcttgatcctgtctcaaaataaataaataaataaataaataaataaataaataagatctttctagctgccacgttgcgggtggactggaggatagcaaaagtggcagcacagagattgctagaataatcatcctgtataataatccaggcccaagatggtggcctggcctcaggtggatgtaggaaaatgggaagaagtaggcttactagatagactatttggaagtagaatgggttagctttgccagtggactggaggaaggtgagggggagatgaatgaaaatgggtcaaaaatggccccctaggattctgctttaagcacctgagtgggtgagccattttctgtgatggggaagggagttaaagcaaagagcaggttctaaaggaaaagctcttctctatctaagagacatttgtcctgctcaccactgtttccctagcacccgctacaaggcctggcatttattaaatgcccccaaatatttgtaaattaattcctctttttagaattcagttgtggctgggcgcggtgctacacttgtaatcccagcactttaggaggcagaggcgggtggattacttgaggtcaggagttcgagacacatgccaacgaggcagtgtggcaaagtgattaggaccatggactctgaagataggactgcctggatttgaatcctagcaccaccattttctaggaatgttcagtaacttctctgatagtttcctcatctggaaaaaatgtacataataactctgcctaccttatagggcagttgtaaggattaatagttaatttatagaaagcactttgaagagagcttcaacctaacaggcgtgatgtaaatgcttgctattgttattaagctgagcgtagatgcaaagttgagataccaagtttgaagtttgatatggggatttggaactagaaaaaaaaaatgtaagtcatcaataagtaggtggtatttaaagccataaacctggatgagactggtggggaggaaggggaggatccaggcccaaggcaactggtagagcatagaaaagcccacaaagaaattgaaagcggttctcagctaggatgaaaaccctgtgagcaagcagctcaagggagcagtggtcatggtgtggtaaatgcttctgggaggccaaggaaggcaaggactgaaaaacaacgccgcccccccaccccggcccccactcctggcaacaaggaagtaaccagtgatcttgagcactttctgcagaatggccagggaggatggaggggttgaggagtgagataaatgaccatgtgtctatacagtgaaattccaccagcctggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggcggaggttgcagtgagccaagatcatgccattgcactccagcctgggcgacaagagtgagactccgtctcaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaatggttgattgtcttagaggtacaggatctacaaacttcccactgtggtccctgctggtgaagtgtgctcagagttccagaagttccctgagttcctgataagacaggaagctaggggagaggagaatattttgcctgaaatgttaagatttttttcccccatagggattcaatgacacgcatgccctggaaggtttcaaaaattggaaataaataaaaattccaagaagaatttatattcctgatggctatgctgatggtcttgtaaattgtatatttaatcaaagacactcaaatgtcttttttttaactattgaagagctatttaaatgtcaacataagtgattccctcccaaatagtgctgtttatacattacttcccctaatagaccataatgattcataaggaggcatttctcgcctctaaattgtaggcctattgaaatataaattaagatgataaataatttgaccttacctgagagtactaagtatttacatgtgtcaaatacgaaattaccctgaacatcatggtccctaaaaaggcagccttcctctcccgggtgaattcattaaatgaaacgggtttataaatttctcttagagtgtggaagagagagagaacacacaaaagaacgggcccggggacccggccgtccccgccctccagctttcccatgaggcccggggggccgcggaacccactccccggcggggagaggcgggtgcagaccgcccccgcgcgcttcccgcgctcccctctccccctccttctgcgacgccgcaggagtttcaaaacatggagtttccacaggaactttgccaggccgagctcgcagccctcccgggctcccgcagcgggattcgccgagtcggcggcgccgcgcggcctccccgccccccacgccctccggggagccgctgacccggcggcctcgggcagctccgcaaaaccgctcggtggctgtagaacctggggaggcgcgggggctccggggctccgcacccccgccgaccccgtccgggccccggagggtggcagcctggcgccctccgcggggccggcgccgagtccgtccgccggctctgttggcttggctccgccgcccggggccggggccgaggagcggaggtcgccggccatggcgagcgaggctgggtacctggccgcccgctctggagttttgttttgaagcccggcgtgggggaggggcagcacctcatcaaggagaaatttcctgttcgcaagcaagactccgcttgcagagtttctgtcctgcccttgacctgacaagtggatctcggctgcgcgggtccccgagagtcgagccagccgcgccaggagcgcgcgggggtgggggtgggggcacccgcgccgaggaccggggagcccggctgagcggggccgacgcctgccctcccggttcccgggcgcacccgggagcgcagagccgagcggtgactaatctgcggctccgggcctcttggcgcgcagcccgggttcgcctcccgccccctcgtctctcctcctccccgccgccctcccagcccagcagcgcagcgctccgccgagcgaatcgtgcgggccagggccgccgccgccgccgcgttcccgggagtgtgggaagcgggtcgaggcgggtggctcgggagccgtctccagtcggcctccttcgacccgggaccgaatgtgcatgtgttaccttccccttaagcactttgatcagcgttttctcctcgcagccgaggagccagagcgaaccggggcttttaaccccctgcgtgccggctccaccgtgggctgagggaagagggtgccgcagggagattggtcgatacagggtgcgatcagtttggtttagcaagcctgagccaggaggagcccggccggatccgaggagcttgcccaagcgcgggacgctctcctgtggagagcaggccgctgaggcccgaggcgactcgttaatgttcaagctctcccaggggcagcgctgtaacgcgacctgcctggccaggcaaggtgcgggcttgaaaggcccggcgggcggaggcttctggaggggcccgggaggccatggcgggacccgccttcacgcacccggttcgttggcgcgtgggtggctcctaaccccggtggaggctttgcgctcgcctcgcggactcggctctggccgccgctccctcccctggtccaggcctcgcttgggagttaatgattgatttactggctccgcgcggccggcgccctcccagctatttgtccaagctgaggagttgctggcgagcagcgcagtaggccaagagagcgggggtcgccggggaagggaagccacgctgccgacgggaaggagaggccactagattagctcccacttggcggctctagctgtgtcggggcaaaccctcaggaagccgggcccgggcgaagggagcattgggaagctccacatgtaaatgggttggcagctggcgattaggccgcccgattttatgagtcataatgggcctcccgcctggccctcaacctgctcgctgtggatccggcgcgcttggggcccaagtggtggaccattccggccgcgcagagggacatgcttctgggggcccaggccgccgaaggagttgagaaggactttctctcctttcttgtagaaggcaacacaaacaccctaaatcaaaccgctccgacaatcgaaggctccacacagacacatcaataaggatttcgcctcccgcgtatgaacgcacagaaacacttgtcctatttttatgcaaatgacaccacacaaatagatctcgcaggcccgggagaggggcgggaggaggaggggcgccgccaccccagccagggggctgtgagaggggaggggcgccaaacccgcaccccagggcccgcgccggctcgggcgcagcggggctggcactggtcaggaggcccgccccgcgggcagtggctccctgccagcgccgccaagtcggccgcgtccccaggctgcctgcagaggcggattagggaaggagcgaagcgagcctgtgactaatcgcggggcctcggaccggagcaccaaggccatgtgcgactgacaggaccgacactagcagaggacacggcgacgcctcgcttaattgcaggcttaaaaaattgccgcctgagcagctctggcgcggagagccacggcttgcgcgtcgagctagggagcgcgcgcgcttgggtgggggcgggggttcctgctctctcgctccaaggttggaacgtttggcgtctcctggaccgagggacctggcccttgcgtcccccactctgctgggtcgccccgccccgcgtgccgaccaagtgtggctgagcccgccaggagagtacgatccagcctccagggctaggtttctgacccgaccctttccccctaaatccgacgtttccccgctttcgccctagatcctatacgggagggggctgtgcagttgggggtgacagattccaacaaatccttaaaataaaaaccacacgcacgaaagaaacactttctcttccctccccttcttcaccgactgatacaaagccccgaatgaccaaagggaaagaggtaagtcggggctgcagggagcaaggtcatcgagtgccaaaacctcggggctcacagacacgcactctgagttcttcacccctggtcacagtctctgtggcccagaccttcctggagcactggggcctctcgggggcgaagggagaagcgtcgggaggccggcggctctgtgttggggagggggagtgggagggagcggagaacccagcgagagaagtttccaccacgctctggccggctactgccaaaatccccggacccctccccgcctgcaccgccttccgttgccaccacaagtttggtttaacgagagctcgggacaaaagcaaacgttttctatagaccccgaaaacaaaggggaaagagacgcgcggggccgcggagaagcggctgctagcgtaatggtgccaggccgaaagcagagcattaaaactgcaaaagccgcgcgggcgggaggaagtgcgaggcgggaggcgggagcgcggggagggcgggaggcgggagcgcgggcgggggaggggcgctgcgccatgtttccgtgtcacccgccgagtcgtcggcgctgggctcggccgccggctcccgcctgcctccgtaacagcagaaagcgtgcgattagcagccagacaggcggggactccgggcccgcggggccgccgcacacgccgcccgcggcccgagcccgcgccccccgcccgccgggtaatcatcctcctcgctgcagcgctgtgtgcactctcattagagtagggaggcttttctctgtgcactcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccccacggggaggggcggggaggcggggtccggagaccccgcgggaacggccgcgcgcctcccagcaccccctcctcgccgccgccgccgctgctgctgatatggcgggcacgtgaagcgcagcttggcgccccggcgccagccagggagcggcctgccccgccgactcagcttacccgcgggcccaggaacgcggaaccgagcctggccgggctccgcggagcccgcacctccgcccgcagctcgctgcggccccgcaccctctccccgcctgagcccggccttggggccgcgccaggcggctcgcccgaggggaactcgggctgactaatgggacgcgtgtgggccttacgtgaggcccggctgtcagcggatacccgcttgctcggagcttagaccgcggccaagcttttcggggaagggcgagaggaggggtttccccgctgggcggtttcagctccccagggacaatccgtccgcggcaggccccaacctttggatcttgcagcctggcttggagacggtagacttggcatgtgccggacgccacggtgccgacccggtcgggggcagggggtgggagcctcggggttgtgagctgggggtgggcagaggctaggtcagcttggtctggggcgcccgccttgaggtttgcattctggggctagccactgggccggggggaatttgcagggcgctctgaggtcgtggagtctgataccaaaaccttcctcgacaaagtcttccggaaaccccttcgcgaaattcctgtgcggaaagaaggatttctaaaactccccgagggtccggttcggctgggagctttcgggttctagggagtgtgatttcctttctctccctttataggggcctataaatatcagaagagtttcttcttatttcgcattaacaaccacttcatgttgacatagttatatgaccctcccaagtataactacctgtttagtttgaaggcactgagtgcgatggcgaaacacaaacatcgaccagtaactaagagaaggaaaacccagccgcgagcttgggttggatacaggataaatcctcatcacgcatccctggttttattcagcctaattgcactagtaatcctgccccccgcgagaaagcctgaaatcctgcagtcgaggtgcgacttttcctggggagccccgccaatggggggtgggttgtcagtggaggggaggtgggttttaaatgtcacttccaaatgaaaatctttctttcttttctttttctctttttcttttttgatccagttttcgaaaagagcatttttgcgagataagaagtgaccgatcaaaatcgctaaggggaggttgtaagcagccgctttgccccagcttagcgttatcttatctctcacacttgcatggcggaaaaaaaaattggcttatctttatccccacccccttctcgccttaattgctaaaaaacactagtgtgttaaaccgggaggaaggaggtctctggagtgtcagtggaaaaggaagattcaaaaatgtgggctcccgggggaagcaagggtggcagaatttattctttcccccaggcctttctggtacaacacagggtgtagtccagggtggaaggctgggtggctctttttttaaattattattttaagaacaaaatctgggcttggccttgggtcgtgtggcttccccaggcctcgctttctgaacttctcccctccttcatctctcaaaagctgctggtgggtctgggttgaggcctctcactctgccttcatcctccctcctctagacacatcctccttttggggagggggggatgcaaggctaggacacatagcctgctggaaatcattaaaatatatgcgagtgtctgcaaacacacacttttaaatcatggcgtttcccctccacgctggtctatttaaactccagagcgagctggatctcctccctctcagtcgtttgtctgtgtcaccgacaggccgctaatggccgggcttccaggcgctgtgcattatgcattagcctcctccctccgccgcacacagaaggttctgtcaggccgcaccacacaaaccaccctgagcccccccaccccaccccccgcactcagggccgggggctgcgcggctgctaacgcgctgggaacgcaggtatggagaggaggatgagcaccgagagcagagtggttcggaaggtggaatgggagcgggtgaaatgtgccgaagattacaccgtttggaatgcccagtccgttgtgagccccaaagctttgctcctggctgcgaccttctcgaggcaaccatcccgcgccactcacctctgtgaccgactttgttgggggcgggagggcagaggtatttagagacagatcagcaccgctttcccttctgctggtccgtacccaccttcctgctgcaggcgaggggctggcagagccttctctacccctccagttcgggagtggtaccgcgaaggggttcggggtggtgcgtcttcgcagggacccggtgggagtggaggagggaagctggatacaaaatggctggggccggaggccggcacactgggtccgaaggcgagtagttggtggttccccgccccctctcccggcggttcccactcactgcccccagccgggtaaaatatgcgcagaaggcgccttgctaaataagcagccgaggcgggacgtggcgtccgggtttatctgcaggagcacccggcccagcgcggcggcgtcgagggctcttaagcccttgccgagcgcaagaggcggccagcctcccagaagcctcctgtattatgcccatttggtcgacacccaaccaccctgcgggcccccgtagtgtagatgccagttcacccacacgtgcctgtgttcggggagctcagggcctgacccaaatcgagcccagaccagaaattccaagatggttgctaggaaccacggagaggctgcccttagggccttccttccccaaacacccaataaccctccaaaggctaggaagaagaaagaacagtcatgttcagcctggcgacccttaagtccagcagtcttctgccctgggaggcagctacctttagatgtttccagatgagtgaaatcctgggaggaggatgcgcctcctgtttgttacctcgtttgagtttcagaggggaagccagctgtgccttgtgcttggaggatggggcagcggatgttttttaaagtgccattggataagcccagagttcttgtacaaagtgaccagaagactataagtgtgggtgtgtttttaaagaaaggctacctcacattatgtaaaaatacattatctgtactcatccgagtcccacctgttccagtaccaagtgtcatcgccctgagaacagcctccgaggaggaccatcggaagcctacacatacgttataagctttatgatgtggatcctagtatacgttataaataaatcttgcacacaaggttagaaggccagggtccccccaaacacaggatgcctggcctttcccctaggccagggtggagctggaggtgtgtgggagaggccctagcgggtcttgcagagtcaacctgccttgagaagggcagccaggctcaaggcctgctcctagaagggccagctcgattgcccagttgcagggcctggttagcctgaggtcgagtggtttgttataatcaggagacacttccatgggaagggagattggtggcggaggggcagcccccgctgctccatccgcagcacctctcatttcggcacctatttctttatttctccgtgggctgcacggcctcccctcccatgcactcctttgctcactctctcctcctcctctgttttcattgaaatcctccccttgctgagtgctgggtatagcagcctgacccccgggtcagctcccgaagggcttgtgggagggcaggagaggagggggcaggagaagggccaaaccgccggcacccattgcaggccccgcggcatccccagctccctgagccccttcttaagtgaggacacaagatgggattgcccttcgacagctttctgcttgttttccccagaacaattggaactaaccgggccaataggtgtaatctcccctccccccctctgccttatagcgcctcgggaaaatcccacattttaattcccagtgagtcacgaatcccccccaccactcatgcctcttaggactcccttaataagatatttttgaaatcccacggagttgaaaaatgtatccctaggagatggaggagaaaccctttaatcctaccagcctaccgtggaggcaagatccctagaaaaggtgggggaggatgttgcaaattacgtcaaaggcgaatttactggcctgtttgtctccagcatcaaatttctcccccagtcagccctcccctcggccccttcgcatttacagcacccccaccacccctgttcattttaactctaggacttttttttttctttttcttttctttttttttttttgagacggagtttcgctcttgttgcccaggctggagtgcaacggcgcgatctcggctcaccgcaacctccgcctcccgggttcaagcgattctcctggctcagcctcccgaattctaggacttttaaagttagacaaacaggcctctttgtcagcagccccgggaggccgtaagactctgagaggctgcaggccccgagctcggttcctggattttctaaaagttctggacgtttacatgcgacttcgaactccgagaaaagcctgtgcctgggggcagagttggggagacgaggggaggggatagaaggtggctgggcgccgggccagggcctctgcggttcggcctaaccgagccggaagagcctggcacggctccacactggcccaggccagttctcccgtccagcctgcagcagcagagcggcctcctcgcctggaaccacgttcagagtttccccacaaatacccagcttcagccttcccggttatttttgacttgttttgaataaaaggagtcgcttcaaaaagaaatgttgccacaacacacaaccagaggccttttctccagctgtgtctgtaactcgcatgcgttcaatctaataacttttaatgtctggtcctaaaatgtctttataaaaaatagttttacagcataatagtccaggtgtctttctgcttgttaccggagattaaaaaaatgtgtgggttggcttgcagagatatccacccccagaaagaccaggaagaaaaaagcgtgcattccattctgcaggcgctggtcctggaagcgttcgcggcccagcctggctgggcactgctcgcgggggcacttgctcgcctgtcttttgcatcagttgttataagcagctctggagcatgaagatttaattctgccgaagtttcgggtttcaaacggtagagatgtttcacttctgctttgagaagggctgtttttataactatgtgctgagaactaaaacagaatgaataaaatcgcacctaataccagtcccacagtcagtagtgagtctaatttttaaaagggaaaatatctgctagctagagctgattttggccttgaccttgacttagtaatcaacttgagatgcttttgattatttttggcatggggacactccaggatattttaaaaactttccgtgtggatttacaagccacctccatttcagatttatgtttcatggagcctgcaccatcttgtccttaggcagaaagagacaccccacccccttcccagtataaaaagaccctagtgggcagccgaatggggtcaccattggccgcgaagtccgggcccgcagtctgggcgcggttagtccggaataccccctcccccactcctaccccttcccgccagcttcaccaactagggcttctcggctcgcccttgaggctttgcgctccggggaggccggaacctcgcttctccgcttccccctccctcccgcctgcccccgccctccccccgcgcccagagccgcgccgggtgcgctggagaagctcaatacgtgtcaattgaattgaactgctgcgggcgcaggctgtacgccgccgccaagcaccgatcagcacgacgttaccgagtggaaatttatggggcgaacggtgtaagccaaaagttgctccctgtcaaggaaaataaaacgcgggagataatctcccaacgccggggcgaggggcctgggcagcccctccaaccatcagaggtacagaccgtgaaaatgctcgagaaccgggagaaatacaggcggatctccgctcgccgaccgccccccacacgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgtccctgtgggcgctccctggggctgcaggctggggggcggggcctgcggactgtggtgggcgaggggagggacatggagagcagagctcagccccctccacatcggggctgggccggtgctccaacaggatgtttgtgttagccccactctcactgctgtctctttggtggcttgttcaatcgcggtgtggaaagaaaggcctctctgatgttcagttcgtgttcaggcaggtaggctgctacggcatcctccagtctcgctaacttatctctgatataaaatctgacacaacccagggcttggcgactaggggaattttaatgagcccttttggattctgattagcaagggggagagaagttattagctctatctggggctgcttgtactgtttcgggtggaagggtggccgtgtagggggagtaggcaggaagtagctgtgtaggtcacagagggaggggggtggggcagacctaaggtctctttctgagtgggggggtacagtagccttagggctgagggctctggagggagggactgagacttttccctcaactcactgcttctccccagcccccctgctcatcctcctcctagcatgggccatgacaatgatagcttacgttgacggagcccctaagatccaaagtaactcatttcaccctttcatcatctttgtgcagtagtaactaatattattcccgctttcagatgaggaaactgagtcccagaggcgttacatgatttgaacagataataatccagcagcctggctccaaagcccagtctccccccatccccccaaactcggctcctctccaggactggctcccattggaatcacgcttttcacagttcaaaacctacgtctgcccctgtgcgtctccccaccacacacttgtcagttgagatagtgatgtaatagcccacagtgcaaagacatttttttttatgctggcatcagctctctaggagtcgtggtgaaaataaaatgcggttcagcaggctgagtgtgaagtgtggagaagcacccgggcgacaggatccatgccaggccatgctcagctgtgggctcccggaattcagccagagcccaggctcatgcaccttaaccatgctgcagtcagcagtctgctgtgccttgagcctttcctgatggggtgacccagctgccagtctccctttgacccagagcccaccctggggcatgattgtgtgggtgggaactgggatgctggctcacacctgtgggatggtcctttgaagcactagctaggtatttttggttgtatgtgactttgtctattcataccagcttgtttcttatcgatatctctggattatctttgagggaactctctagaaggatttgaaaattagctcagttacttgcagattaaacccaagtggcagccagttggtttcccataagctgagagcagcggcgcctatgaggacagggtagatgcagcgtgccaggcagggccactcattcctacgcatgattgggaaaatggacttgtgcttccagcaaacaccagaggtaagggagggctccagggcagcaaacttgccggccatagcggggtagggctcctggcctggtctttgatcctggcttcatttctgccagtctcacctttctgagcccagagcttcaagagacccttgtgggtgctctaaggaacagtttccattctggtggttttcctatagcaggcctggactaaggaacactgatccatgctttcttaggctaccaggcctttggtgcaagaagccttgagaatgtttatggaaggacaacttttccccttcaaatgtaaatgtcattatagaactttcccaggtcatcagttttgatgctgaatgttttaattactagatgaaagctttcaactttgaatccaactttctgggatttctttagtcagaaattaaaatgttaggatgatagtccattcagatgtggcagtgtaaaccctttaaaataaaagaacagtttgcttaacaggataaggtacggtatgaatgcacagctttgggagaggtttcccaaaacccctctttatcattgtcttctgcttagctaaaaagataccacatgcaataaaaaggctgctcaagctttgttttctgttaatctggttcttgaggtttagaaacaccctctgtcttcagatctgtaatagaccacctgaaaggccagttacagttgaacctgtctgttcttaggctaagatgccaatgtggaaccgcatgtgtgtgcatttagtagtgatggttaagttttctatgaatcgaataaatcatgtttttaaaaaagttaatgaggcatttaattaattaacaatgtcgggtttatggcctttatggttacattttgcggttaatgtcattcagcttatagctgcttaacagagaattgtccaacaaaaacagtttgattttgtttgggaatgggcgggctgcccttcaaacactcccatttccagcgtggagaataaaccaagtaatgtaatgggtagacagacttgtctggcttcttcattctctctgttggtgacagcggttgccacccatttaagatcccatcaccctcccatctaggagagtgtcattagcctgcttgaccccaacagaaaaggtgcaagggatgccggtcatggctggattgcagccctctagccagggcccttgattgggcctttggaaacttcccagcagacccgttgccaaaagacctgagttatgggtctgatactttgtgttaattgaatatggggcttaacctctctgggcctcaacttccttgagtgttgaatgagactcataccacttttccttcctgagatctcacaggtcactgtgggatatgacatacacatttgggaacatcagaagtgttacggtggccaatggcaaaacgtctgacctggttgttgggttactgttgtcttgcctgccatcctccaggataacagagttgacttacccttcagcctcgacatctttcatttctatgttccctcagatcagccctagtagtgatgaaggtttccaggtgaaggccataattgtcagagcaaataaaccctgggttgataggacaccaggccggctgccgggatccgggtagattgatctgtgcacagcagtcggtggcgcttagagctgatccctgagtcacgtgacagggcctctccctggctgggtacacagctcattagcttgcagccgtccactcgagtctggctagtgagggcctgctaaaagagcagcagcttcatgcggtatcctggataccagtgctcggggcaggtggcctgggagctcagaggattgtgggctttctggcaggtgagggcctgaaggaagagacgcatctgtgggcatgccttctctcttcctccccttgatttggaagggagctgccgcagtgtcctgaagcaacagggttaccggccagggttaccagcgtgcagccttaggttcacagggggagcatctagaacattctagttagtgttcaagtgagtgatcacctttgactgatgtgtcttagaaagggcataaaagaattttcagaactcacctcacgtttatgggtggctcaaatgctgcctattttaggttatagatgagttatttaagagttgtcacaaaggagagcctgctgtgacccatcaagctccccccttgccaagtggaacatgtgttgggctaccccacatgttctggctttccccccagtcttcagaacctgacagctctctgctggccatgactgctaggaaaacagtgtaacctgttgtctggtggcagatactgttccatgtgtttgaaaactttcttaatcaaggtaataaaacatggactaaattactgctctgcttactgggagcggttcattttaatgttttaacacgccaaagaagtgagattaataacagtgattctcatgcaaactgttgatgcggaacacattctgcaaagggggaagggaaggattgtcttacttagttcttgaaatgcgtaggttgtggtatgtggtgtattagattcctgtcattaacttaagtaaatatgaaaatatattgattcagccccaagtggggcggagagtgaagcaaaaagaaggtagggttattggaagcgttgatgtcatttgttgatgagtatgataccaacagaggcactgccgcccaggctccaactccgggtctttccaaggggcgtgaggaccagcctaaactcctgggcatcctcctctctgtgaagttgagaaacgttctccagctcatttaattgttcattatgccttgattggccttgcttttatctaaacttgtgtcgtcatccactactacctattggatgaatcgattgagtgaggaggatgtccttgtacttattcatgcgttgtttgaaacattagcaaccaaatccctctgtactcactgtgccaggcactgagctaagggcttgtgtgggtctctaattacagtttcttagcagcctctggtaggcgctgttactctcctccagaggtaggaaaggaagctttggagaattaggagcataactcgcccagggccaggcagctgggcagcagacccctaaatgatgctgtccctgtcatcaggcgcttcgcacatgtgtttccccctcaccaagacatccacagcccgcccgagaggttctcaggttctcaggcctgagggtgtatgtctttgaaagctacagagaggtccaccttacaaggtcattgtgcagtgatctgatggcattcttccctcccctccccacaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggtcagtgatgtgtcttgttctcagcctggctctgctgagaccaagcttccctatctgtgcggtggtggttctcagtgtatacgggaaattccaggaggaaagacagagggtgactgtaagcacactgaccactgggttctctggaattgaatccagcagacctttctggcaaatgtagatgtaaagctcccaattttgatcagtcctataatgttcctgtgaaccaaagcttctgaaaatgttgaggcctgcatgaataattgggggtgttgccttttaagaccctggactcttcatcaccatctatgaagtcactgtatttaaaatatatttgagctgaaagtcccaggagtacacacagagtgccagctgcccctccgctggttcagcaggacctgccattgccacccacatccccagccgtggccctcaccctgtccttgaccctggtttattggtcagagacccaggtctgagtcagcctgaacatcttcctggttgtgtgagtgggatgctgccatgaggctgggcactgggggtttcctgacagtgacagaaatagccaaacggaaatgtatttggtgtttcacactttgcaaatagcattccctcagattgggcagagacccatcttctccctgccaaccccaacccccagctccatggacacaggtaggaggcctctgtatcctgctgagaacacaccccaccaggcctgtttcttctccccaccgttcccttggcttctgggccagaggttaatcactgatctgtgtgaggtcctgggatcaggctttcaggagagtctctgctaatctctttgcatctagtttcttttaaaaacagaggtggcttttttttttttttttttttaatgtgtgacagttgcttgttgtattggcttccatgatgatgggacctcttttatcccctgtaagttaccttcatatggtccatgactacttaaatttgttgaaaatgttttcattttgggcttgacttccttcttaggccttggattaagatagggtttgcagctgggcagtggctctcttgcctgtaatcccagcacttttggaggccgaggcaggaggatcacttgagcctaggagttcaagatcagcctggaaaacatagtaagaccccgtccctacaaaaagaaaaaattagccaggtgtggtggcatgcgcctatagtcccagctatgaggaggctgaggcagaaggatcacttgagcccaggagatcgaggctgcagtgagccatgatccgccccactgcactccagcctggacagtggagtgagaccctgtccacccccacccccacccccgcaaaaaaaggatagatttgggtttgagatttaggcctgaaatagtctcttcatctgccctgtaaagggttagtcatcaaaataacagtgattcattgcttgacgttgagccactcactgtagctcagtttccctatctgtgcagtggcggtgactgtgcacacctcctggatgaaatactgtgcttaggaggctcagtacccaaggtgcacatgtgcccagctttgcctgttgcttttaaaggagacaactgctttataagcaagtgtggcttgcatgagcataattctattgcgcctctcttcctaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggtatgacaaagttcaagaaatggtcttattcaaaaattagatgataactcgatacaatagatgattggaatttgactaggcagaaatcacaaaggctgaaactgtaaagcttttaggagagcagccgagtgtttgaacttttgtgtggtttgactttgttctagtgaagctaagtcatctattcaccctaatgttttaaaagatttcctaaagttattcccattttccacacatgcattcttaacttaggtatggctcataggtttacatcttgagtctgggaaaaatgactcaaaccttccatacatgaaattatttggacaggtttatggtgttaggtcatcagataacccattacttaagccctgggcattacaaagtgcctaaagcagaagcacaaggttttcatgagtgtcaggcacctgcagttaaagtccttatcaggcacttcctgccaaagaatgccactaactcactggtgacctgcccttgtttaccttaaattacactcacttgttggaagaagcagcttagttaggctatcaaagaagagatacataagtaggccggacacagttggctcacgcctgtaatcccagcactttgggaggccgaggcaggtggatcaccaaaggtcaggagttcaagaccaacctggccaacatggtaaaaccctgtgtctactaaaaatacaaaaattagctgggcatggtggtgggcgcctctagtcccagcttgggaggctgaggcaggagaatcccttgaacccgggaggtggaggggtggaggctgcagtgagccgagattgtgccactgcactccagcctgggcaacagagcaagactctgtcaaaaaaaaaaaaaaaaaagagatacataagtgtaatgctactttattttgctgagaaagaggaagacaggaaatgaccttccagcctgtcatgaatgtataggaaaaaatgccacgtggctctgccatcattttgttctcagcagtagattttatcttgtttttttatttttctctccctccagattatttaaatgacctccagggtcgcaatgatgatgacgccagtggcacttgggacttctatggcagctctgtttgtggtaagctgcattgtttgctctagttccgtaggaggtgaacaagttcaagtccatttctgtctggtatgggtgagggaaagtggatggtgggcactggaagcaggactcacttgggaaagaatcttgttatttaaactccttgttgttgttgacaactgtggacatcttgctgtagtttactgattccttcctctcttatttgccctccattagaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggtgacaggagttagaaatgcgctttgagcagatgagggtgggtgggtgagtgacctccttaactgtccacgaacctcacacaatgcagtagatattttccagaaagggtacacatcagcttccttacacccagtgtggtggggggtggggcacagcatggtataaacctgccctcatcactaacaccaaggcttaagtcactccccagagaagtgggtgactggaactttatggaagggtcagcaccttggatacttaaatccttaaacactttgagaaggtgtcctccctaggactgcctgcaacagaccactgtaggatgttttgagatgtacggactacactgataaaccaccttgtgtaaggttaggacaatcattgtacatgacacttaggatattggtgtgtcatcagatttagttaatcccctctgccccctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcctgaatggagagacagccttgtgtgtttataatgctgttagtgagggtctgaggagagaagagatcaaagaaatggggatacagacttactctcccagtgactgttgatagcagggcacttggataggcttgaccctagttgtggtcacagctgaatgagcaggactttacccccagaaaggggagaaatggggcttattcagatggtcctccctagatggacagatgagtccagagttcctactgctagaagtagttactctgcctcaccttagaaaggaatggcgatggccgggcacggtggctcacatccgtaatcccagcactttgggaggccaaggcgggcggatcacgaggtcaggagattgagaccatcctggttaacatggtgaaaccccatctctactaaaaatactaaaaagtagccgggcatggtggcgggcccctgtagtcccagctactcgggaggctgaggcgggagaatggcgtgaacctgggaggtggaacttgcagtgagctgagatcgcgccactgcactccagcctgggcgacagagcgagattccgtctccaaaaaaaaaaaaaaaaaaaaaaaaaatggtgatcagagagtaggtatggtgagaaatgaggggtgggagcagaatgaaaggacatagaggctggtccacttgggttggtagttaatattaatagttgggcgcacttttcattttactggaaactcaaagcattttcctttctgttttgtaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggaga

SEQ ID NO: 1120 - DNA, 125898 bp, mus musculus; identical to SEQ ID NO: 1119

SEQ ID NO: 1121 - DNA, 15805 bp, mus musculus
ggctgtccttagacagctcttctcatgccgggcagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactggtaaggaccgaccggacatgggactgggatggagatcattggagaaggggttagggagagtaattcctcctggaaggctaggctaggccacggaggggaactaccgtgcccaagaggagaaagatagagtgttaatttaagcaggaactcataagtttctatagtcaccactttacaaccttggtctctttctagacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggtaaggggaagaggctgtcgagtgggcatggaagtgtagaaaggagggaatagactagttcatgggagatagttttcagagagctcgaggagaggcaaccaattgcctttcctctttattgagcagagaccccaggggtgatgcactggaaagtgacctcttctctttgaccaggagttcatttcttccaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactggtaaggtcctggagacttcagtacaagtcacgattttgtagtttttagcagtaagcaataagggggtaaaaggctaagttcaggatcatttcttttaactctgtgtccttgttggttgcagataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcaggtaagagaataatctctccatggtcctggtgtgacacacctgggatcccagggacagtccccatggagacatcccaaatcaggagaatggaggagctttggagccagggacctgaagtgtgtcatctttctcctaaggatgatgaggaggtgggaccttaaatatatttgaagatagtgagtgggtttcttttcaggcctcttttccccaaggaaaggagggctgcttctgcttcagcataaactctgccactgcccaccccctctgtagtctgaacagatggctcccacgtgaaccctaaagaaggccagagtgtggggcaataccagatcaaggggaacatacacacgctaatctccatggcctcggtttctcctctttcatcaccacagggcctgttgctcaggagtgcactgtagggaacattgtccgaagtagcctaatcgtggtggttgttgtagccttgggggtagtgctagccatagagtggaagaagtggcctcgactgcgaaccaggtaaataaatgcctcattatggcccccttctgtgaaccaggtggtgctagaaaaacaatcatacaaatgctcccctagtatctgagccccaccgtgcaatctgttttcagtttctgggtcctcccttactcatgtctttttctttacatagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaa

SEQ ID NO: 1122 - DNA, 74096 bp, mus musculus
agctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaa

SEQ ID NO: 1123 - DNA, 81918 bp, mus musculus
acctgtcggaaggtcctctgcaggtcccccttccgctctgccgatcgacttccgcctcgggcagtcaacatgtacgttgcggctgtctggcgaagctgcttctgagcgtttgcggaggcgcagcttcccctctgcggggccgccctgcttcccccccatccccgcctccccccgcccctcgctcctgtccctggggtcggcggacttctcgctacatgggggcgggcttccgcggtcggcgcacggcttcctgttctgaggcggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctgtaagtgccccgaaacccctgcctgttccccagccccccttcccgcccaaccggctgagacgtttgcacctccctctccccgagaggctgctgtgttctccgctggactgcttagtctagaatttttgaactcctggggttcagcagaggtggagaagaagctttgtatctggggtcttcctggcaacgatgcaacagagacttgttaattttgcgtgttgttacacttccactgaaaattgtgtgaaatttttgtccgagttcccaacagaactctcttgatttcttggctggaatacataatattcgagcttttagaaaaaactctatagatgggaaatttgtattacagcctcttgacgatacgttttaaatgtaagctgttattgcttctaagttaatgcaggagctacatacgttgtgtataaaatacaaatttgaattcaaagtactttttttctggaacttttgagtgtttgaggtcttaatgaagttagtgtgagtaaaatttttttgtaagtagtctgttatttcttggagtatgaagggggtttataaatcacctagttacccatgaaatgccttggggcatgattaagttgttaatcccttcagaataggatcagaatatactaacgaatttcagtgtgtgaagaaaaggcaccgtaacattttgggactctgttgtacatcttataacccaggttcagaaaaagttaatcagaattttattttttatctattgcaagacttcagatcagggttatcaattgagatacattagtatgcagatattaggctctaaagcgtcacagtaatttgtttttagagactgataacagatacttgtttgcagatgactgaaagagtaggctctacttaactcctgtaaaacgtcattctcagttttgatgtattgtacttttttgaatgggacagaaaaaagtagtgttaaagaagcctacccatggctaatgagaaatttaaatcgctgtcaggtttagggactattataatgatatacctctctgcaccatttattgttggatttcataaaaatccaagaatatccatgagaaagtttcatgtatgtgcctatatagagctgtgggaaaaaaaatgttgaaaactgctgctatcggtggtgtaatttgcttttccataggggatttgtagaaattccttgaattgtggttgtctttttactattttaggacttggcttatgaagagaggaacatctgttttattgccgtagaataagtatgtagttatagtcccacaccctttatgtgatggttcccatatttgtatctccagcacagacctctctgatgaactccagactctatatccagatgcctacatttcagtatcttgatgggcatttcaacatagcaactccagcaccaaactcctgattccactgtcctccctcctgcagaaccttctttgctatctcactagtctctccattcttcctgttgttgctcaggccaaatattttggaataactcctggctcctctctcttcacatcctacatacatcagcaagtcctgttatctttgacttcagagtctgaccatttctcaacacttccaccaagtgctggtccaagccacctaatccttcacctgtgtactgcaatagtcagttcactggtatctctgtagttcccttgccccttctatagtttcttctccacaaaatagccaggatgattcttttaaaatttctctgcttagaacccttcgatggttccccatctcactgagattaaaaagtgttgataattgccaggtgtggtggcttatacctgtaatcccagcactttgggaggctgaggcaggggagggggtcacttgagcccaggagttcgagactctgtctctaccaaaaatagaaaattagctgggtgtggtggcccaagcctgtagttccagctacttggaaggtggaggtgggaggattgcttgggcccaggaggttcgcttgagcccaggaggttgaggctgcagtgagcatgttcgcaccactgcactccagactgggtgacagtgagatcctatctcaaaaaaaaaaaaaaaaatattgataatcatctgtatagtgaccataaaatttatagtccaaaccgggacacttttgagcataatggggctgatgataataatgtcagaacaagaggcataaaccaggactgtcttgggcaaaccagaaaaccagaacatgtggtcatcttacctttaaggccttacatgatgtgccttctctgttccttaaccttttttttttctccaacctcttaaccacttttggtttgtcccttacctctttaactgcatgtcctgaaactctcctctttgcttatcctgttccgaccacattacccttcctgatgtttcttttttatttttgagacagggtctcactctgttgcccaggctggagtgcagtgtggcacagtcatgctcactgcagcctctcgacatgggctcaactgctcctcctgcctcagcctcccaaatagctggaactacaggcatgcgccaccacgcccagctaatttttttatttttggtagagacaagagtctcactatgttgcccaggctgatcttgaactcctgggcttaagcagtcctcccacctctgcctcccaaacctttttttttttttgagacagagtctcacggtgttgcccaggctggagtgcagtggtgtgatctcggcttgctgcagcctccgcctcccgggttcaagtgattcttgtgcctcagcctcccgagtagctgcgattacaggcatgcaccaccacacctggttaatttttgtatttttagtagaaatgggatttcaccatgctgaccaggctggtctcaaactcccaacttcaggtgatctacccgccttggccttccaaaatgctgggattacaggcgtgagccgctgtgcccagcctccaaaccttcttgatgtttcttgttagtgcctagcacactgccatcttagagcctttgctttttccctagaaatctgtgtgaattgctttctcattagtcctttaggtccttgtttacatacaatttatcagaaagattttctctgaccacctataaaatagtactctgccccttcactctgtccttcttacttgctgctttatttttctttacagcacttattgccacctgacattattagtttgttgtccattcccaccccatgaggacagagattttgatttgtttgtgactttccctggtgcctagaacaatgcctggcacacagggcttaactaagtatttattgatttaatacatgaatgaatgaatgtttagaattgtcataaatcaatatatggtttgatagaagaaataataactagtgtttgataactcagtagggtgactagtttgcaagaatctactgtacatttcaaaatagctagatgagaataattcagatgtttccagcataaagaaaaaacaaatatttaagatgatggatatcacaagtacactgatttgatctttacaaattatataaatgtatgaaattatatgtactgtgaaactgtacatgcttaatgcatcaataaaaatattgttcaaaaagaattgtaaaccatgggaaatttaataggaaaagttatttttgttcttgatacacaggtatacaacttttttcacttttgattgtggtaattattaattaattagtttgggaacttaccatggaagttcctaaatagtgtattttccctaaaaactgtcaggattaatatgttaatgtagagccagtgttcgaggtatactttatgagtctttagggaaacagttacttcagtaatatgtgatgcttgtgtgtgaactattgaaggtaaaaaggacaaccttggcaacttaggtggttttgttttggtctcagatttctgggttttttccttctgcttgtccacctcccttccccctcaacatacatgctctcatcctagagtttactctctgccttgactttttagagacctaggttctactctttattttttttttttgagacagggtcttgctctgtcacccaggctggaatgcagtggcacaatcatggctcactgcagccttgacttccagggctcaggtgattctcccacttcagccttccaagtagctggactacttgccaccacacttggctaatatgtattatttgtagagatggggttgccatgtgtgcccaggctggtcccaaactcccggactcaagcgatctgcaccccacccccccgccaccaagcctcccaaagtgctgggattacaggtgtgagccaccgtacctgacccccccgcccccttttttttaaacttcttttaattcagaaaatgccaggatctcagtcatgtaatcttgtcttattgtgctttggtgtaaataagtttctatgccttacttcccaacatttgcattttagaacttttactctaaatggtagctttcttatccataaaagaatttcaaatagattaggaggaataggggaaaggggaggcaggcagcaaagcctgtcttttgtccctgaactgatactaccgctgacatgagatggttcttttagggtctctgaggcaggtaggaggagtgggaacaatgattcctgttctttctacccccagaaactctgctccccttctccccttatagatacccatcgttctcattctccccctcccttgaggtgaaaacaagggctgtggcttctcaaggagtgttctcaagaggtttggcttgtagaggaacttgccagtagctgcctttatttgcagtcttctaacagggccttaatttctgcttcatctctccggtctgctggcccttccagcccccacctagttccctttatcattctgaccataactttaacttccatctcaccgtctaccctaagagtaggaggtaactataagccagagatcattttaatattttctcctccttgtactttgaacctctggaagtagttttagtttttctgttcctgtggcacgtgggtgggagacaatctaaatggctgggtgtgtgtacttcaagaactgattagctgtgggagaggcatgagagttgtttaggccattgaatcttggactgtgggatagaggttaacagaatgtggcaattcaggaggcattaaggatctttctaggcatcagtggatgtgaatgttaaatggtatagcttatctgggaagaagttgacattggttgctggctatcagtattggaggactagcaaaaagaaacttaaaaatcctgttggagctgtttaaaagcaataaaaatttttcatctaaccaccatgcagcataattactgtaaaacccttgacatacactggtccttttgtatgcttagcttccagttttgtccaccataacacaatgtggagggattattgcttggaaacaggtatccattggatacagggaggctggcaaccaagtagtaagttcttctgcatctgtgaccattttggtcttaaaataatcttttctctgacaccctatgatatagtgtgctaatgtgggacttgggctttttaaatgtttaaggttcatgcaatacattttgaagtattttgaatggagaaaaatgttcttttgttggtttttgccttataaccatactgctggaaactcataaatctaaaaaagagtaggtagctacatgagcctgtagtagctgtttacccagtttttctgaaacattaacgtatttaatagagtcaaagtaaagactattatcacattagaatgaaggtatgcatgtatctaatccgttttttttttttcttcttagactgccaaggaaatctgatgtggaaaggtgagtatggaaaaaaaaaacccttaaagtctctttattgatcaatctatgagtgttggtgtgtgggtatgggtggtgtagggctgtggattggaaacctaggcccaaagagtctagaatgatttttcacaccatgtatttagggagtcctgggaaatgtaatttcctcacccttaacaatacttgttgtgagaccagttctaaatcttctgttctacaaacctttattgagtgactgacctggtcaagtccctaagggtgatattaagataaagaaggtatagtctgtaaaggaagatgctgaggagcagcagactggctttagaaagttgactgccacgggcatagtggcgggcgcctgtagtcccagctactcaggaggctgaggcagaataattgtttgaacccaggaggtggaagttgcagtgagccgaggtcacgccactgcactctagcctgggccacagagcaaaactttgtctcaaaaaaaaaaaagaaagttggctgctaatttatcacttgcaacaatgatgctattaagtatctttagagagttgacatttgcctactgctcctactgttacatagttaacattttggttcagttggagcttggagcttaagatttaacttaaggctaaaatgtttccagaggccaaaggaacaagcgaaattaaagtttcaaagaaatcatttgatggagatttaaattgtaactaaagtatatggtacttgaccgtatctttggcactacttatgctccttggttgatttttttttttttataccaaatcacttggcaactttttagcatttcttaatggcaacactccattgccaaccccaacttaactttttgatcgaattagagatcaagaaggtagaagtgaaagagacaactagggcaacctgtgttatggtttggctggtcagtattaaaggaggaaaacgttaagtcaaggatttgttctgtccgctctggggtatgaagggaaactgggcctttgaaaaactgactcatgttgcctagcacttgagacaacatggtgtcagaaaaccatgttactatagtttacaaagggggacatctccattgtagtagaggactgcatttgggaaaccgaattaatgatagacaagtgtgtttgctctgtgagaggagcagagaccttgcatcctctataagccattgctgagttagagtgaaaggtactgaggttcccagccctgagatctgctggatcttaatgtgtgtttaacatttctgctatgtctcagtcttgtcttatgatccttcgtagacactggcaaagagtcataattatgcccttgattcttctctttatagtaccactaatcatattgctggccgatttttaagagagccttttagggtgcttgtgggctatgtgtgctctcagtaggagctagcctctagccttcagtcaggattgtacttcagcaagaacttttactttggtgcattgcgtcatggtggtggtattggcaagatgcagagatgtggactggatctgcaggtcattgaacagctgtactaagattaataggtcagagtctacttggagggaggttggtgtcctgctgggtctggtcatcggtcctggcttgttgaatatttttttcagtgttttaaagtaaaccataaaagatatgattatcagttttatagctgctatgaagttgagagatctagctaacacgttgattgacattagtaaagcttttgggattttaggatgagataaaagtactgatgagtattaggggaaaagtaataatagtgagtataggataaaactagatatggacagaccttttatttttagtactcaacataatttctttagctttgcttggatattttttaatgtatccaagtttgtcattgaaattagtttggtaaagagttacatagttaagttctttaattgctcaatctttcatgctggtgcaggatgggaactggtgcccttttgtagaatgaatacagtttcaggctttggtaaagatcagtttcaattcctttcacttaccaaaagggttactaattacttactaattaaattactcctaatttcagttatgaacttataattcataactcctcatttaatcccttctgtgaagcagtttacttctaccaccatatactgaatttagtatatttttgtaaacaacttttattacaatataaaattaattttaaaatgtgacttattgctaaaacattctattgggtttattgctctgaggtgaaaaagcatatgcagataatatacaaaatgtgacaatagttcatatttagataaatattttaggtggctcattttgtagtggttgtaagcaaaggctgatttatttatttatttatttttgcttagctgaaataaattgtgaaatactgtttctaatatgttggttcattaagagttgttttattttataggaaaatagaaatagtgcagtttgctagccggacacgccaactcttcgttcgattattagctttagtgaaatgggctaataatgctggcaaagtggaaaaatgtgcggtgagttaaactttttattttactttgtataaaataacttttcgaatgttatgatagacatagttttacattttagctttaacttatccctgctgatttgagtgacatgtgaataatcatatttctgaatgataatgtatatttctgcagaaacttagtatttgtttatggacacctgatcagaaagaagaggagatagctggagacatcattacgtgaggagactttaaatatgagactggaactaaagggggaaaattgttagtttatattcgtgctattccttagaatttgcaaggttctcccttaaattttgcttatgaattcttgacatcctgtgagaatggcagagttggtttttttttttttttccagttttacagatgacaaaatgataaggttcctagaagttacatggcttcttcaaggtcacagaggctgataacagcatttttctgtttgtttatctactaattctctaaacctctaataagcacagggtatagggcacagaggatggaatcttcaataaggaatagtccctgccttcgagaacctcatggtcttttgactgttgaatcactctttggaatgcaaagtgacatgcagtgcagtgtaccaaagatgctaaaatctaccaaaaataaagttttatgctatgttcaagaagcgttaaggagtaaaaacttgattgtttttcagattgttcactattggcatatagaaatactactgatgttttgtatgttgattttgtattctgcaactttactgaatttatcagttctaatagttttttggtggggtctttaggcttttccaaatataagatcatatcatctgcaaacaaggataatttgacttcttcctttccaatttggatgccctttctttctttcttttgtctgattgctctagctaggacttccagtactatgttgaataatagtggtgaaaatgggcatccttgtcgtgttccagatctgagaggaagggctttcagtttttctccattcagcatgataattagctgtgggtccgtcaaatatggcttttattatgttgaggcatgttccttctatacccagttttttgagggtttttatcatgaagggatgttgaatgctattacatgtgttttcagcatcagttgaaatgatcacatggtttttgtttttcattctatagatatgatgtatcacagtgattgatttgtatattttgaaccatccttgcatccctgggataaatcccacttggtcatgatgaacgatctttttaatgttttgttcaatttggtttgctagtattttgttgagaggatttttgtattaatattcatcagatgtattggcctgtaattttctttttttgatgtgtctttgtctggttttggtatcagggtaatactggccttgtagaatgagtttggaagttttccctcttccactattttttggaatagtttaagtaggattggtattagtttgtctttaaatgtttggtagaattcagtagtgaagccataaggtcctgggcttttatttgctgggagacaaattataattaatataatgaattatagctccattcttgttacttgttattagtctattcgggttttgaatttcttcatggttcagtcttcacaggttgtatgtgtctaggaatttatccatttcctctagattttccaatttattgtcatatagttgcttacagtagccactaatgatcctttgaatttctgtggtattagttgtaatgtttcctttttcatccctgattttattcatttgggtcttctccctttttttctttgtgagtctgggtaaaggtttgtcaattttgttcattttttcagaaaaccagcttcttgtttcattgatcttttgcattgttttcttcatttcaaattcatttatttctgccctgatatttattatttcttctaattttggtttcaggtttctcttgcttttatagtctttaagatgcatcattaggttatttatttgaagtttttcttcttttttgatgtaggcacttataactataaatttatctcttagtgctgcatcccataggttttggtgtgttgtgtttccattatcatttattacaataaatttttaaattttcttcttaatttgttcattgactcaccgttcatttgggagtgtattgtttccgtgtgtttgtatggtttccaaaattcctcttgttgttttctagttttattccattgtggtcagagaagatgcttgatattatttcagtttttctgaatgttttaagacttgctttgtggcctaacatatggtctgtccttgagaatgatctgtgtgctgaggagaagaatgtgtatcctgcagcctttggataaaatgttccataaatatctattaggtttatttgttccacagtgcagattaagttccatgtttctctgttgagtttctgtctgggagatccgtccaatgctgaaagcggggtgttgaagtctccagctattattgtattgacattttgttctttaataatattagtatttggtttatatatctgggtgttccagtgttggatacatatatgtttacaatcatatccttttgctgaattgactcctttatcattaatgaccttctttgtctcttttcatagtttttgtcttgaaatctattttgcctaagtatagctactcctactcctttttggtttctgttgacatataaatcttttcccatccctttattttcagtctatgtatgtgtgtctttataggtgaagtatgtttcttataggcaacggatcattgagtcttgttttttaaaatctattcagccactctgtgcctttttattagagagttttgttcattacattcagtgttattattgataagtagagatttactcctgccattttgttgttttctcattgttttgtggtcttctcttttttccttccttcttgtcttcttttaatgaaggtgattttctctggtgacatgatggaatttcttgttttttattttttgtgtccattgtatttttttttttttttttttttttttttctgagacggagtctcactctgttgcccaggctggagtgcagtggcgcagtcttggcccactgtaacctctgactcccagattcaagcgattctactgcctcagcctcctgagtagctgggattacaggtgcatgccaccatgcccagctaatttttgtatttttagtagagatggggtttcgccgtgttggccgggctggtcttgaacttcggacctcaggtgatccacctgcctcggcttctcaaagtgctgggattacaggcgtgagccaccgcgcccggcccattgtatggtttttgatttgaggttactatgaggcttgcaaatactgtcttttaacccattattttaaactgatgacaacttgacactgattgcataaacaaacacacaaaaagaaaactaatgaaaactctgcagtttaactttatctccctcctttttaacttttttgtttctctttagttcttattgtcttcaaaagttctgtatcttcaaaagttgttgtagttacgatttcctgttggtttaccatttagtctttctactgaagataggagtagtttacatagtacaattacagtgttataatattctgtgtttttctgtgtgctcactattaccagtgagtttgtaccttcagatgatttcttcttgcttattgacatatttttctttcagattaaataactccctttagcatttcttgtaggacaggtctgatgttgatgaaatctctcatcttgtttgtcagagaaagtctttatttctccttcatgcttgaaggatgtttccaccggatatactatcctagggtaaaagtttttttccttcagcactttaaatatgtcatgccactctcttctggcctgtaaggttttcactgaaaagtctcctaccaaacatattagagagcaccattgtatgttatttgtttcttttctcttgctgcttttaggatcccatctttatccttgacctttgggagtttgattattagatgccttgagtcgtctttgggctgaatctgcttggtgttctataatcttcttgtactttaatgttggtatctttctctaggtttgggaagttttctgttgttatccttttcaataaacttactgcccttatctctctttttctgcctcctctctaaggccagtaactctgagatttgttcttttgaggctgttttctaaatcttgtaggtgtgcttcattcttttttgttcttttgtcttttgtctcttctgactgtgtattttcaaatagcctgtcttcaagctcactaattctttcttctggttgatcaactctgttattaagagattctgatgcattcttcagtatgccgattgcatttttcaactctagaatttctgcttgatttttaaaaaaattatttcaatctctgttaaatttatctgataggattctgaattcattgtctgtgttttcttgaatttctttgagtttcctcaaaacagctattttgaattttctgtctgaaaggtcacatatctctgtttctcctggattagttcctggtaccttcttttgttcgtttggtgaggtcctgttttcctggatgatcttgatgcttttagatctgggcctcaaagagttaggtatttattgtagtctttgcagtctgggcctgtttatgtctgtccttcttgaggaggctttctagatattcaaaggtacttaggccccaagctcaataatgctgtggtttttgccgactcatagaggtactgccttgatggtcttggataagatctggaagatttctctggattaccaaccaaaggctcttgttctttttccttagtttcttccaaacaaacaaagtcttgctctttgtgctgagccacctggaactgggggtatggtgatgtaagcacccatatggccaccaccactaggactgtaccagctcagacctgaagtcagcacagcactgggtcttgcccaaggctcagtgtaaccactggttacactggtaacctggctaccacttaccttcactccaggccctagggctctatgatcagcaggtggcgaagccagtcaggtttgtgttttttgggatggcaagtttccccaggctttgggtgagcccagagatgctgtctggtggccagggattagagtcaaaaaccttagtaatttgcctgatattcttttcttactgcggctaagctggcactcaaaccacaatacgaattccttcctgcttttctctcccctttccacaggcagaggagcctccccctttggccatcaccggctcatgggaggggttctgcaaggccaccactgatgctcacttaaaatctaagggttcttcagtcagcttgtggtgaatactgccaggcctgggactcatctttcagggcagtgggcttccctctggctctggggaggtccaaaaatgcagtccaagagcctaggcctggacttggggaccccaagagcctgcttggtgctctaccgcactttggctgagctggtacctaaggtgcaaaacaaagtcccctttacttttccccctgcttttctctaacagaaggagtctttcaccatagccaccacagctcggaatgtgcttggtcacacctgaagtcagcacatttcagagcccaaggtccacggcatactacctgggtatcgccgctggttattcagggcccaagggctcttttattcagcaggcgatgaatcctgccagggctgggtcctttccttcaaggcagcaggttcccttctggcccagggtgtgtctttgtcatctgtgagctagagcctcgaataggggcctcactactctgcccggtaccctgtcctactgtggctgagctggtatccaagatgcaagacaaagtcctttttactctttgctctcctctcctcaagcagaaggaaggagtctcttttgttgtcaaaagctgcgctgcctggggtttgtggaagggtggtggaagcactcccttaggccccccagcgggtgtatccctaggtcatgtgccacctagtcctctggctctgagtccagcctagcactaggagttgcctaggaattgcagtgcttgtgtcctagacagcctttcatgtttacctaggactccagagtactttggccaacattagcaaggcttgctgagaaactcaagttccaaccgctgcgatgggcaattctctagccaaggctggtccaaatgctccctctggcccagcacagctttgctctccactatgacagggcagtactgagttcagtgtaaagtcccccagtcactattctctccctcccttaagtgcagggcctctgttggggtggcaggggaggggtggtgtcagggattcaagactgcctctcctgccctcctcaatgcctctttcagtgatatgaagttaaaaccaagtactgtgattgctcacctgatttttggtttttgtaacagtgcttttctgtgtgcagatagtaaaaatttcgtgttcctggagagggggtgactggtgttggcttgtattccaccatcttgctctgaccctctcagcatttttgttttctgaatgtagatacagatgtgtttatgtcagggataaagtccatcaatgagaattagagggattgttcatgtttcagcacttctgttctcaacctaatgattatttaactagtttgttagagattcttgataatgatctttagccatgccagatgtgttatgagtgtatagatccatagtttatggaactctgactaatggtaaaacaacctggataatgttttgcctaagaaaaagataaaatatctctcattctcctagatatttttttcagtagctttactgagatataatttacataccatactattcacccacttaaagtatacaattcagtggtttttgttatattcacagatatgtgcaaccatcatcacagtcaattttagaacattttaatcacctcagaaagaaaacctgtgccctttagttaccaccccagctctcctctagccctaagcagccactaatgtactttgtttcaatagatgtgcctattctgaacatttcatataaatggaatcaaatgtgttgtgttgtgattggcttctttaacttagcatttttttttttagtgtagtattttcaagattgattcatgtggtagcttgtgtcactacattcctttttatggctgaattgcatggatatactacattttgtttatctgttcatcagttaataggcatttgggttgtttccagttttggattattatgactaatgctgttgtagatagtcatgtccaactgttgggatgtatgcttttatttctcttgactgtatacctaggagtgggatggctaggtcatatggtaactctttgttgaactttttgtggaactgccagactattttacaaagtggccacaccattttacatttccaccagcaatgtatggaagtttagtttctccacatctatgccaacactggttgttacctgactttttgagtctagccatcctagtaggtatgaagtggcatctcattaaagttttaatttgtattttcctgatgaccagagatgttgaacctgttttcatgtgcttattggccatttgtgtatcttgtttagagaaacatttatttggtgttaaattctaaaggagattattattaaacatattcacagctggtgtgtgaatacctaaaaataacatggattagttctttgtgaactaagactatgtgaatggattcactaatcagttactcaaaactcaagttttatcttttatttatttattttaagacatgaagtctcactctgtcacccaggctggagtgcagtggtgtaatcacagctcactgcaacctcaaacttctgggttcaagcagccctcccacctcagcctccctgagtacctgagaccacaggcactcacactactgtgcccatctaatttttaaaaagtttttatagagatggggtcttacttggttgcccaggctggtttcgaactcctggcttcaagcagtcttcccgcctctgcctcccaaactgctggggattacaggtgtgagccaccacacccagccaagttttatctttattaattgtatttctaagttcaaggaatgtagctgaagctagtgtattttgagttcagtgaagtagtttagagagtgtttcattaattgtttatgtttaagtggagtgataggggctggataaactgtggcatcccagtagggttgatgcatgtctttctgccggggaggtctttggtactctttgagcttgaccttggtctgataagcatttttacagtgacctgagttaagggagatgtgagatggcctaaatctgagtaaaagccagttaaaaagttgagaatgtattagcagtgtcatgactgttaataagaagttagtgttggtggcattgatagaaattcattgtactagtcatagaaggtagcatttttactggaccatgctgtatattgggtctaactaagaattagaagaaatatttttgttgttgttgtttcagctcttctgattattgactttctttgggcaagtgtcttaacctaagcctcaattttctcatctctaagatcatagtaattatctggttgtacttcctagagttgcaaaaatcaaataaaatgtttgaaaacactgagaaattgtagagcactgtgtttgtgtgatgttggtattaattctgggtactatgttttaagttggccactgacagcctgtttgaaggacatgagagagaaaactttaagtgttgttctagaatagaactagaagatggccgggtgcagtggctcacgcctgtaatcccagcactttgggaggctgaggcgggtggatcacctgaggtcaggagttcgagactagcctggccagcatggtgaaaccccgtctttactaaaaatacaaaaattagctgggggtggtggtgcactcctgtaatcccagctactcaagaggctgagccaggagaattgcttgaacccgggaggtggaggtcgcagtgagcagagatcatgccactgcactccagcctgggcgacagagcaagactctgtctcaaaaacaaaacaaaatgaaacaacaacaacaaaaaaaccatgaactagaagataaaggttttagggaggtagtttttagctctgtgatgagctctactagtttaggtatccttatgaaatgcattgggtagaaaactgatggaaaggatttctgtattgggcatgaagttgacctgtatctcataatgggtgttttggagtgttttctatgttctttctaggcactgttctaaaggttttttatgtgttaactcttttttttttcaattgatatatcatagttgtacatattttgagggtacatgtgatattttgatacatgtacatagtgatcaaagcaggataattgggatattaattacctcagacatttttctttgtgttgggaatgttacagttcttctcttctggtcgttttgaatatacaataaattattgttaattataatttccctactctactattaaatactggaacttattccttttaactatatttttgtaccaacttttcttcatacctcctccccccttcccagcttctcctaaccagcattctactctctacttccatgttatccacttttttaactcccacataggagagagaatgtgcaatacttgtctttctgtgcctggcttatttcacttaccatagtgaccttcacttccatacgtgctgttgcaaacggcaggctttcattcttttttatggctgaatagtattccattgtgtatatgtactgtattttctttattcatctgttgatggacacttgggttgattctgtatcttggctattgtgagtagtgctgcagtaaacctgggagtgcagatatctttttggtatgctgatttcctttctcttgaatatatatatactcagcagtggaattgctggatcatatggtaattatatttttagttgttagtggtttttttttttttttgagacagggtctcattctgtcacccagactggagtgcagtggcacagtcatggctctttgcagcgtcaacctcctgggctcaagtgatcctccctagtagctgtgagaccacaggcatacaccactatgccaggctaatttttttgttttttaattttttgtagagacagggtctccctatgttgtccaggttggtctgcaagtcctgggctcaagcaatcctcctgcctctgtctccccaaatgctaggattacatatgtgagccaccacacacagcctatttttagtttttttttgaggaacctccatagtgttctctgtagtggctgtagtacttcacattcccaccaacagcgtgagggttccccttcttccacatcctcacaagcatctgttattttttgtctttttgataatagtcattttaactggggtgagatgatatctcattgtggtttttatttacatttccttgatgattagtaatgttgcattttttcataataccttttggccatttgtatgtcttcttttgagaaatgtctattcaggtattttgctcattttttaaatggagttatttggttttattttgctattgagttgagttccttatgtattctggatattaatcccttgtcagatggatattttgcagacattttctcccattctgtgggtggtctcttcacactgttgattatttcttttgttgtgcagaagctttttagcttgatataatctcttttgtttatttttgcttttgttgtctgtcctttttttttttttttttttttttttttgagacggagtctcgctctaccgcccaggctggagtgcagtggcacgatcttggctcactgcaacctccgccttccgggttcaagcaattctcctgcctcagcctcccgagtagctgggactacaggctcgtgccaccgcgcccagctaattttttgtatttttagtagagacagggtttcatcatgttagccagaatggtctcaatctcctgacctcgtgacctgcccaccttggcctcccaaagtgctgggattacagacctgagccaccgcacccagcccaggccaatgtcttagagcatttttccaatgctttcttctagtagtttcatagtctcaggtctcatgcttaagcctttaattcattttcagttcatttttgtatagtgtgagagatgggggtctagtttcattcttttgcatatgatggttatcgagttttcccatcaccatttattaaagaaactgtcctttccccagtgtatgttcttggtgcttttttggaaaatgagttggctatgtgtggatttctgtgttctctattttgcattatctcttaatacagagaacaactttatgagattgggaatcatgatcacctccattttacagttgaaaaaagctgaggcacaaagaggttaagttacttgcccaaggttacaagactggtaagtagcagagttaaaatggagaacaaggcagtctaggtctaggagtccatgcttttaactccttcattaccaaccaactctggaagtctgtaagaggaaaaaaccattttattctacttatttttcctaactttgatattatgtgtgtgtaatgttaaggatggagaaatgaattagaaagcttttacttaaagtgacagaaaattattgctcttaatatcaaatactagtgtattaaatatttcttcttcaagttactggagaatatttgaagaactactttgaaatatggaaaactgatactaattccccttgaagtttactttggaatgatttaacaatatttagtgtgaaaaggagatagttttcagggatgcttaatacatttaccctttactttaaagatgatttcaagctttttagatcagcaagccatcctgtttgtggacactgctgatcgcctggcctcgttagctagagatgctctggtccatgcacgcctgcctagttttgccatcccatatgccattgatgtactaactactggatcttacccacggctgccaacctgcattagggtaagttctttgcttgcccccatgttcctaaaaactaaaggttttggcactggattggattgtattattaagtagcccagcaaaaaacattgttaaaacaaacagtacatatagtttgctttttttctctgtaactaaagttgtgcttttttgaaataagttggggccagatgtgagtagatatcaaaatgggtgaaggttttatttttttttcccccagggatgcgcggatgtgcagacataacatctatttcagatgtgaaaatgctacatgctagttgctttttgaaagtgttttaaacttttattgttttggtagtttactgacttggtgccatattgtattttatacttgtaagaacttgtggaagctatcaagtgatatttagttggtttataaatagagcattaagggaggtcatgttgtattatgatcttagctaaatgactagaatcattgttgctcttatgcatgatagtaatggccattgtttttgtaagtagactgcagaaatgagtgttaagattctcttaggtaaagtacgcaacactgtataaagacaggaaaagattgaaaaaaaaaatccccgtttgtacattatttaaaaatcacttaaatttttttgcaggacaaaattattcctccagacccaattaccaaaattgaaaaacaagccacactccatcagctgaatcagattcttagacatcggcttgtaaccacagatcttcctcctcagttagcaaatcttacagttggtatgtatctgaaatttatttttttaagagttgatggccaggtgcggtggctcatgcctgtaatctcagcactttgggagactgaggcaggcagatcacttgaggtcaggagtttgagaccagcctggccaacatggtgaaaccccatctctactaaaaatacaaaaattagctgggtgcggtggcccgcacctgtaatcccagctattcgggtggctgaggcatgagaattgcttgaacctgggaggcagaggttgcagtgagccaagattgcaccactgtactccagcctgggtgacagaatttgcatgttagaatattttcctaaacagctttttgggttttattcaaggaaaaatagcatcatgaagatttgactgacagttttatggtgtttgattctacgacttgccagctgtatcatttctctttagtacctagaaatacagtgctggtatttgcagcttgggagtggggctggaaagagagaagagtccccagagttgtgcctcaagaaaatattgttcatttatgttagaagagttgcctttcatttcttgacctggaagctggctacttcttattcaggaaccattgaattgttggaaccttatgaaagaaccttcaatctatttaaaaatttttataagtaagactgaaaattctaggtcaggaggaagattctcattttctagcaaagtacacttctttttcttcatctttttcttctaaaagcaaatggccgggtgaagtttcgtgttgaaggagaatttgaagccaccttgactgtgatgggagatgaccctgatgttccatggcgtcttctcaagctagaaattctagttgaggataaggaaacaggaggtaaatcataagtagtgatttaaatcataagtattagtttaaatgtttgattttttatattattgaaatattcccggctggggatgatggctcatgcttgtaatcccactactttgggaggccaaggcaggtggatcgcttgagctcaggagtttgagaccagcctagacaatatagcaagaccctgtctctacaaaaaatttaaaaattagccgggcgtggtggtgtgttcctgtagtcccagctacttgggaggctggggttgggaggtgggaggatcacctgagcccagggaggttgaggctgcaatgagccatgatcatgccactgcactctagcctgggtgacagagcaagatcctgtctctctatatatatattcctgcaaaataataaatgcatgcagcaatttatcctgtaatttgaagcaagttttataattgtaactgcctgttgaccgtggaagtttcagtgtttctcagagtacaatgtcaagtttctgtagataatttcagtgctttttaaaaaaattcattgttattatgtgcttccttagttggtatagtgacacacttgtacacctatttaattaactgctttcttttcttctgccaacggaagatgggcgagctttggttcatagcatgcaaatcagcttcatccatcaactggtgcagtctaggctctttgctgatgagaaacctcttcaggatatgtacaactgcctacgtatccttctgaaatttgagacatatatttgtaaggattttgtggtacctctcccacatttttcatttgtccttagtcttgaactgtagcagcctacattccttgcccccatctcccccaccctttttgaggtgcagatagggctggagaatagtgaagaatagtgatatgtttgtaataaaccaaatttaaaattttactgttgactttgcaggtaaaagcaaaaagtgattagttaaaaatagtcttgtttgaggctgggcacggtggctcatgcttgtaatcccagcactttgggaggctgaggcgggtgtatcacttgaggtcaggaattcaagacctgcctggccaccatggtgaaaccctgtctctactaaaaatccaaaaaaaaaaaaagaagcctggtgtggtggcgggcacctgtaatcccagctactagggagcctgagacaggagaatcgcttgaacccaggaagcagaggttgcagtgagccgagatcatgccactgcactccagcctggatgacagagcaagactccgtcacacacacacacaaaataataataataaaaaagtactgtttggtgaaaaaaatagtactatttggtcaatccatgttctctaaactatgatgaattaagacacaacccagactttatggttttatattggtttaaaattaaatataaaacctttttctgaaattatgctataaattataatactttttacgatgaggcattggagaaataatcatttcagaaattttcttcagaaatttttctccaggttttcaataagagaaccttccttaaatgaagttctcctggacttgattgactgttggtgtaatgtattaattttacttaacaacatctatcagattctttctgtttatcacttcagttagaagtgttacattcccaaactctaatgttaatccgagaacggtggggagaccttgtgcaggtggaaaggtatcatgctggaaagtgcctctccctttcagtttggaagtaagtaaaatcagttctggtgggttcgtgctatgactgtaaatactctttttatttctctttttctctcatacatctgatttaatatacagttgacccttggacaacacaagcttgaattgtgtgggtccacttatatgcagatcaatttgcaagatgtgaaacctgcgtatagggccaaccttccctatacgtgggttctgctggctgaccgcaggactgactgcaggacgtgagtttgcgtggattttggtattgggacgggaatcctggagccagtctcccaagtataccaaggaatgactgtataccaatagctatgcacctctagtaacatgcttttgtgtagtaaggtcccatagtattatgtagaccacataggacatccatagttgacacctgtcttagaacatgttttaaatacatagacatttacctgtttgtactaagacttactattcttaaaaagtttgagaggttagtttactttgggtttataccaaatagctaaaagaccgttaggttagaaaagaccattaggttagattgttgggtatcattttttaaaacatgcatgcttatcacagttttccactttgaattgtgcctgttaaaaactttctttgggagaaaattcctattggactgtttgtaactctcaattccctgtttgaactttacttgattcctgtttttctccccaccccggcatcttattatcccaaatgacccccattttctgtaaaggagtcagaggtgagtagatactacttagaagacaggtagtttttgttttggggttctttttcatgtgtgcatatgttttatttttaaattatatgtcttttttaaatgcaataaatcaaatattgtattggattacagaatagctatcttcccattattattccctccacaaacactgggggcctgccgtattccaggctgtggctaaactgcacaatggattgtctctattttattctagaagttaacagactgtgttgaaaaaaattcttcatttcatttttttctttagtcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaaggtaaaagatctcaatatattttcatattggtttaaatgaatgtaacttgccatttatccttaaactcttagcacaaatttttaaaaatatctaattcttcctaaaaccttttatgaaacttattttaagtaaatgttacacttcttacatttgtttttttaaaacatctgatactataatatataatttttaagatattctttcatattttataatttagatcagataccattttaattttaaggtctggcattagagcaccataactgatttgtaatatcttctcctattacttaccaaaatgttaactatagtttttaagctatcaattgtaagttaatttttaactcaataccatattagttaatttttaactttaagtttgctttctattagggttaacacttaatcagtgtgattccaaaaggaaatattttgaagcacagtaatctactcttgggcttttaaagtaaaaatgtttaaattgcacatttgaatttgttgttcttatttatgcagatcgaccacttatcaatagaaaaactcctgattgacagtgtccatgcaagagctcatcagaagctccaagaactgaaggccattcttagaggcttcaatgccaatgaaaactgtaggttcttttaaattgacatttgtttttcttttgtttaaactagaatccagttttatttgatgagaatcttaatatgactttttcttgatattttgcttttattgtggaagctggtatttctgcattttaacttgtgatctgccaaacttatgctaatttttcccttgttacttatttagcttggccttatttttgaaatatttgtgtattggatttccttaaaactttatgaaatggggctgggcatggtggctcacacctgtaataccagcactttgggaggccgagatgtaaggatcacttgaggccaggagctttagacaagccagggcaaaaaatgagaccccgtctctatttataaaattttttaaataaaaaagaaaaactttatgaaacatgagctaacattttaatatgaaccttatttttaaacttttttctagtgataaaacagcattccaaatatttataatatacttgtaaaatatgcccctttgagtgaagcagaattcatcccttgtctttttaaaaaatttttaaaaattattaacagttcaaataaggaatgcagatacatggacatagtgaaaaatcttccaagtttaattacctagtaagtatattcagagctttgagggacagtcatttagaaagtaaaccctttcattctgggaatataggttcgcaacatcataatgggcatatttactatccctgccccaattgtttttggccataattaccttgtgcccacagtgcacagtctttaattaagttagatgacgtaagtgaagtgccttataagtaggaagtcttaatagtgctagtaacgaaggtgctgccttttgtcatcacagagctcagctcaatccattatacttaaagaagcagcttcttaggtatgtactagtaactctggattaaaatcactttgacagaaatagattttaaaaaattgcctgaaggaaagacagaaagttagaaaaataagtgtgtatttagaatacatactcattcaaggaaagtgaaaagatagaggtgaaagaggggatctaagataaaccaaagcattagcttatatttttaaagagactaaggagaggggcagcctaacttaacaaaaatgcaaatatgggccttaaaaaagaaataaaggatctgccagaaatttggtgaatgtattggttagatgtgtcttgggggtgcctgtccattagccctatcagggtttaacattagctttatcagtacttcattatcttaatttaattaaaagcttcagtagaaggccctcccctttaatccctcaagcaaagatgttaaatacagacctaaaaattatgattggaaagtataattgaaactctcactggaattagaaaggctactaaccaccactgccttttcgtctttttttcttaacagctttattgagatataattcacatataattacctcattcaatggtttttactgaaagagttgtgcaactatcaccacaatttgattttagaacattttaatcatcccagaaagaaaccgtgtacccattagcagtcacaacccattcactcctctcccttcctgcctcccttttggcaatcattaatctactttctaactctatagatttgcctatttggacatttcatataaatggaatcataatgtgtggtctcttacatactgtttttaacacattttttttgaggttcacagcatgtttcaatacttcattcacttttattgtcaaataatccattgtatggctataccatcttttgtttatccattcatcattgttgaacattggggttgtttttcttttttggctattgtggataatgctgctatgaacattcatgcccaagtttttatgtggacgtaagttttcatttctcttggctgtacacctaggagtgtaatggccgggtcttgtaactgtttaaccttttgacgtgtttaacaccactttacaatctaaccagcaatgtgggaaggtttcattttctccacatcctcaccaatacttgttattgtttgcattcttttacgtgaggatatgcagttatctcagtaacatttgttgaagactattttctcctgtttaattgtcttgtcacccttgttgaaattccccttttgttcttttttaagaaatggagtctcactgtgttgcccaggctggtctctatctatctatctatctatctatctatctatctatctatctatccatctatgtatctattttaagtccatggcctgctgaacaggctggtcttatgctcctgggctcaagcaatcctaccacattggcctcccaaagtgctgggattacaagcatgaaccaccatgtccaactcttttgttcttaaagaagactttaagtattttgcaatcttaatttttctaatttttcaaaacttcgtttgttgagattccagaaaatagggagtttgtaatcttttgataggctctggtttactttagtatcatctgtaagcaaggcttagtaagttaaaaaacagaacaaaaacttagtaagttaaaaaacagaaacaaaaaactatgattgccaagggatagttaaattactttgaaaaataaactcaaagcatacgtttacataggaatggttttgtgtgctgttcacctaggttctgaagatttctaaagagaaatttagagaaatcttcagaacccaagtgtaaaattcctttttgtagaaatgttagagatctgagttcagctgtctgctcttgaacaagtcatttacactatttgggccattctcctcatctgaaatttgaggatattataatagtccaggctcttcctagatcttaaactctagtaggaatgtgctacaccagtggttttcaagccctaggtgttttgtagagtcccaggtgttagagaagggtgacttagggactataatttggaaggaagggagaagcttgcatgcggggttgatctcctcagttctgctttaatcaggacagttctagaaatgaggactgctagaggaaagggtctgccgacccaccatcttagggcatgtgctttaacttgttctttaaattcatgtgcatgcatttatactctccatgtagtcttacttgatccttttttgtgatgggcgagcatgctttattaagatccttactgggatgagggactacatagtctattcttagaatcccttagcgcagtcacccttaaatcagctggcttttcttctaacacctaactggaataacccaaggaaatgagtagctcagagagtggagcatttcaagggaaggctaggggaaggcatagacttcaggttttgagcagctcaggcatgtggtttcgtgggggtagaaatggtttaggggagaggaggcaggactttggagataagttccaaaaaagcagtgcaaggtactaaaggtaacttgagatatggcccagttggcagcattgcctaactcttgaaagccagggtgctgctcccttatgttgtactctacccttcagcacttataatcagggcatcatgatcagtttggaagctatgaaccacacacagccattcctaattgagcttagttgccgctcttcactcttcacactttatattctgtctgttatccattctcatcttgttctcaataaatgatagaaataaaaggagatatatatatgttctggcaggacgaaatagcagcaagtcctgtcatcttacactgcttttaattccctcttctttattttctttgcaagtttccccatttttgtatacctaaaacctgttgcctttaaatgctttagggcattgtgtattttattttctgtaaagaaaaatatggacattggtagtcaaaaaattgtacatcgatttgtatcagagtatttcttgtcttttgaactgtgttatctgtattcttctctgatgccctatttttctaagaatactcaattgtggtaattagattgaaattataattgttaccccaattcccagaactagttttactctgttgccacgctttagaaatggttttgctttagagaattcactcctaccctgtcaggaattgtgacactatggaaatgtttcaaaaatcagcaactctgtttcacatttgtaataactttttattaacatagtaagttcagcaaaatgtcactgatttgaactaatttgtcacattggtctgaattatatggtaaaagaaatttttgtttttgccctttttgttctgtttttttcaggtcagagttctgctggatttgcatgttaaacattttgtatacaaatatgtattagatgtacaggttgagtatcccttatctgaaatgcttgagaccagaagtatttcagatctcggattttttttgggttttggaatatttgcatttgtacttactggttgggcatcccaaatctgaaaatccgaaatccaaaatgcttcattaagcatttcctttgagcatcatgtcagcgctcaaaaaattttggattttggagcatttcaaattttggagtttaggatgctcaccctatgttttaaagcaatttatttctctctaattaaatatgtcttctgcaatcttttactttattaatttgtttgataatttgtgtagacagtaccaatggtaatgtcatccatttgaattattgaaaatttatagtaaaaggttttggtttgtttctttgattcaaaaggaatatagataatatacatttgtcaaacactttgctttttaaagcacttttacagccttgtcatttcttgctcctaacaacctgtggcatggaggggaagatgttattttccttgtttgacaaaaaagcaggcagaagccacgcctggtgaaaggcctgcatcgccactcccctctgcgcctgccacgttacctctccttccgagcacctgcatcaccattctcctctgtatctgccttttttttctgtgctgtagcttcagaggaacttggtaacaagaagagcatattccttttacaacccctcaatctgatcagcacttagtgtgttttcagtgttttgcttgtttactggatttcattatgtcacttgcagaattaagagaaaagttaattgggcctcgtggaaatactgtgaaactctagatcaggcatattgtcagctttggggatttgtgtttagcaattgcctatgttcttaattcatctgtgacttgaaatggagtatacaaatgacttgaaaaaaatttttcttcctgggtaatcaataatatttattagtttaaacacatgggctctaattgccagaatacctcttttttatgaggaatggcattgaaaatcatgaggccatagaagatatttattctgtttataaacaactagttttctttccattatacaaaagagaaaatccttaaaaattaattagcttattagtaattaccaagtgaaagtaaaactagaactcagctcactgatgaagttgaattttcactagctatttcaaccctctttaagaaactttggattttttttgctgtagtatttgagacaggcatgtttgtttcaagtcaccttgaaaattacattctttcctttttgagctgctaactgacataataatactattgcaaattttgcaaaatcatgtttttcctctaacatttaggatccttcaatagttggtttgtttgtactcattgattgagaaataatttttctggaaaatattcagatagaaaaataatttttaattcttgattgttcagcttccatagagactgcactcccagctcttgttgttcccatcttggagccctgtggtaattcagagtgtctgcacatttttgtagatttacattctggaatgtttcaattgatgctttatggacttggtaagttactaaatgatataatcattcaatgtaagaaaaattatttttaacaaaaacaaaataaacattttctgtcattaggtattagaaagaatggtatatgcagtgttgaaagtgggtatggaaaccataactctgactgatgtcagttcctcggggccgttttaactactttggattttcttgtagcagatgttaaacttcccagtataacgcacattcgtgtttccttatgcaaaattaataatgttgatggctgctgttttttaggttaacttatctatcccagtagctcagtttctattttaccactgggtgacatggaaatcacaataaggaattctaatgtcatttgtggctgaagaacatttttatgacagtagaaacatctaagatgacttgaggtacagaatcctggaggaaaggatttttttttctggcctaaacacagtagaaattaaagtttgatttcttacttgttctgttactgagtcagtgttatgaaatgatgaaataagaatttagtgtttttgtattgctactggacagtgttcttgaatatattaggacatctgctatttgaaattaatattcagctagaaaggttgaaaataaagggctttctggttatattttatagctatagattttttttctatgggctgctcatggaaaactgaactaattactttgaatgacatcacatttatgatggctaaatgacgcatttatgaattactttaactgtgggttccaaataaggcaaatgttgtttgttcttaaaaacttatatttaggccaggcgtggtggctcaaacgcctgtaatcccagcactttgggaggccgaagtgggcgaatcacaatgtcaggagatcgagaccatcctggctaacacggtgaaaccctgtctctactaaaaacacaaaaaattagccagacgtggtggcgggtgcctgtagtcccagctactcgggaggctgaggcaggagaatggcgtgaacctgggaggcggagattgcagtgagccgagatcgcgccactgcactccagcctgggcggtagagcgagactccgtctcaaaaaaaaaaaaaaaaaacaaaacttatatttaactgtttttctgattattaacatagtacatactcataaataaaaaacttaaacacacaaaaattagaaaagcaacagaaaatagtcttttagggatgtatgcttgtcttagcagctcaggctgccgttaacaaaatatcatagactaggtgacttaaacaacagaaatttattttgtcatagttctggaggccagaaattcaagatcaaggtgtcagcatggttgatttctgatgaaggctctctttctagcttgtatatagattgtatatagacagctgccttcttgctgtgtcttcacatggctgagagagcgacttctctggcatccgttcttataagtctgctactgatcccttcatgaagtccctaccttcatgacctcatttaaacctaattgcctcccaaagaccccttctccaaataccatcacactgaggattaggggtacaacatatggatcttggggggacatagttgaccccatagcagtgcttttctaattttttctatactttgtccccattaatcaaaatcattttgtatcttgcttttttttgctcattattctgtttactagcattttctagtgtcattaaaaattctgacttaatttgcaagctgatcttcagccagcagctgttccatatgccagagatcatttgtgtttcataagtaaatatttcagtggagttttttgtttttatgatttttaaggttctaagtctaataatactatgagttttaaatacttataatttaaaaatactgattaagtagactaggagtttggggaattaaaatataggcaaagaatggattcatgtatttgttacttgttctttctgccagtgtacatttgccattagttgtcatatctataatgctccctaaaagttaaagagggaaaacaaattaggttggcttatatctaatggtacatttagtttaatttttctctgactcaaaaacaacatgattttctgccttaaacaataattttcatttgttttatttgttttacactacctagataaagattttgtttctcatataagcaattaattaatgaagtgctttattctgtagaccaggccactctggatgacatggagaagtctgtgaatgatgatatgaaacgaatcataccctggattcagcaacttaagtaagcttatttatatagctcaagactaaaaatggaaacttattttgacaagatatgttttcttctccatcattactcttggtcattcactgtccttaaggtttatgacatgaaacttaagtgccgtttggtaccttagaatctaaattctcttggaatagttccaagatgtcagtttctcatatcaaattctcctctagagcaaatataggtgtgaagggcataacactcagctttcatcccttaccacattttcttctatacaagcactttacaaatcacttacacaatgaattttattgtatcaagtgttctctgtaataaagtcctatttgttcttatccagggtaatcgtcatggttgactaccaactgacactttcaaaatagtcatttctgcttctcgaatacagtcattcaatttgtctcaaaatcctttaaatgcttcacactgttaaactaaataaaattgaaaatggagctagatataattctgtggagtttcattaccactctggtacacaaaggtacccttatagcaactctaacaaactctttcttaaaattaatagaattccaaaggataaaaaaaaaattcagagactaaaaccaaaactggcaaatggagaaggcggtgggggggcggtatctaaagaaaagactataaagtgggatctattgtttttataatcttttagcctctgcccttccctttagccaatatttgaaaaattcaatataaccaagtaatgttttcattagcagggcatgaatttttttttttttttttttttttttttttgagacagggttttactttgttgccaccaaggctggaggggagtacaatagcgtgatctcagctcactgcaacctctgcctcccaggctcaagcgattcttctacttcagcctcctaagtagctgggaccacaggtgcatactaccatgcccagccaatttttgtattcagggcatgattttttgttttattttatttatttatttattttttattgagacagagtctcactctcttgcccgggctggagtgcagtggcgtcatctcggctcactgcaacctctccctcccgggttcaagggattctcctgcctcagtcttccgaatggctgggattacaggtgtgtgccaccatgccaaactaattttttgtatttttagtagagacggagtttcaccttgtttgccagactggtcccaaactcctgacttgaggtgtgatgtgcctgccttggcctcccaaagtactgggattacaggcgtgagccaccgtgcccagcgcagggcatgatttttaaagccagtagatagataatattatgtgagcctttttttttgagcagctatttagtgtatctgtatgtgaaaaaaaatcagtcattaatctgggtaatgatttctaaaacttttagtgttttagcatcattgtgcattttggctaaataagcaaggtttaaatatcctaacatgcttaataattcacatcttgcataacttgaggttgtttatctggcagttctagctgcccaaaatataaactaaaaccagaaagttaagttccaaaagcctttaactcaccaaatgtgtgcctgtatgtaaacttacatgatttatttataagaaaagtcccctgattgtcacttataatagtgtttctcagatgatttgtggtgaatgaccagtttatcactaatctatcatgggacactgatttttcaaaataactttattgaggtataatttacataccataaaaatgcacccattttaagtatacaattcaatgatttgtagtaaatttactgacttttgcaagcatcaccacaatccacttttagaacgtgtaggacatttccatcaccccaaagaaatgtccatttatagttaataaccattcccaacctcagaaaactatgaatccactttctatttgccttttctggtcatttcatataaagtagaatcaaaatatgctgtcttttgtgactggcttctttcacttagcataatgttttcaaggttcatccatattgtagcatgtatcagtacttcattcctttttatgactgaataatatttcactgtatggatataccacatttggtttatccattcatcaattgatgaacatttgggttgtttccactttttggttattatgcataatgatgctgtgaacattcatgtgtaagtctatatgtggacttatgttttcttttctcttggagtagaaccaaggaatggaactgctagggcgtacagtaatttgtttagcttttaaaagaaaatgccaaactgttttccagagtgactgtgccattttacaacctcatcagtaatgttgcgagaatttccatttctctacatccttgccaacaattgttactgtctttgaatatagacatcctaataatgagtatgaagaagtatctcattgtgattttcatttatatttccccaacaaataatgatgttgagcatctatttgttcatgtgattacttttttaaataatgtgcaataaaaatgaattctaggaaaaaagaaatgaaagaacatgtataagatataagccccaatgttttttattagaatcaacagataaagttatacttcagtaaatataatcagaacataggaaaaaagaaaattatagaaactgtgtacatttttcattgaaagtgtatacacaggcaattaatatagaaagtcacttagactcaagttttttgtccctcagaatcataacaaataatgaagagtgaaatagcaattccagattgactttgaaaaggccaccttgtatatcagtatttagaatttttaatgtgacacatgagcttgtttcttgtttgtaataacttgtccacgttggattgatgataatgctaatcatgagagatgtttcttatgttttccttttaataacatacatactagagaaatcattctcacaaaggtatgttgatgggaatcaaagtagagatttgaaataaattttagcaagttcaggatattcatttttaacttttattcaaaatgaagcaagtgatggtatattttcaaaatttatcttcattccttcatcagtaaccagttcttgcatttgatccgtagagttgtagttaaatttgtctttcaatgaaaaaaacaaaatggtttccagaacagttgacaaactacccttaaaatgtcatatattataacatggttttactgcacataactggtatacagtttgtaccacatgcaacttgccacacaaatgtatcagcacccaacctggtctttgccctattcatcaaggcaagtctgctgatcatgagctgggatgttgtggcatcgttatgctgctgtgaaaattcttattttctgtagtttcattatgcatcagtggagtttgtgaaccagccattttatcccttttttacatattatatgatatcctagcttcaaggatagataatcaaataaaaggaataaaaggagtactatattaaaaacgtcagtgaaatctggcagcttacctgaaaggaacgtgggaacaaaggtagttaatactactgggacccgctaggtatactacacacttcacacatacacaatttaaaaactggggctatataaagaatgttgagattagttggtgctgtctttaaaccgtaggaaatctgtcactccttaataataaactaacatagtatctcatccttacagtgaattctaccttataactaagatcattcacattgcagtttaaacttcttaaactaaaactagaattgacagtagtgcaaaactatgaaaaaatgatttgtcattatggccatgtgtccttttattagttcagttaaatttcaattaattgtttttttaatggtctttaatcatttgtaaatcgatagggcacagataatcagaaaagtctgagatttgatgtggattatcacttttaaattcaggttttggcttggacaacagcgttgcaagcagtctataaaacatctgcctacgataagcagtgaaacattgcagctttccaattactcaactcatcctattggaaacctttctaagaataaactgttcattaaacttacccgccttccacaatactacattgtaagtatgcaaaggagtgatttggagtgatcaagtttagtaattctgttagtatcttgaatgacttattgtttaacttgccaatgaattttattgaatatttgactttggtatagtgaaacccaggggtttagaattggggagagaggaatgtcacgtctcagttggggaacataaggtataaccccatccctcactctagggtctgtcctgtgatgaggcctagtctttgattggaatgagacatctctgtaagaataaaaaatttaagaccaattcctatgaaggtctggcgatgttttgatgtcagataaacttgtttcacttgaaatattaacttgtatagtgaaacctttcaaatatggactggctgaattagctttattttttcatccttctttgattgaaggcatctttcattttattgagtatgtgttccttttagtgcacagtaaggtcctctctattcctttttcactgtttctgtatgttttttagtttctttatttttgaattagttaaaatttgcaataattttaaatatgaacccatcctgaatatattttcttgcttgttgaaatttctggccaggcacggtggctcacacctgtaatcctagcacttgggaggctgaggcgggtggatcacgaggtcaggagattgagaccatcctggctaacacagtgaaatcctgtttctactaaaaatacaaaaacaaaacattagccaggcgtggtggcgggcgcctgtagtcctagctactcgggaggctgaggcaggagaatggtgtgaacccgggaggcggagcttgcagtgagccgagatcatgccactgcactccagcttgggcgacagagtgagactccatctcaaaaaaaaaaaaaaaaaaatctctgtatataccaagtagatatgttggctaagaatctatgttttacaaattttaattcaggccaggtgtgatggctcatgcctgtaaaactaacactttgggaggccgaggcaggaggatcacttgagcccagaagtttgaggtcagcttaagcaatatagtgagacctcgtcgcttataaaaataaaataaaaattttaattcaagattgtttgttgaaagtaatgggagtgaactttttaaggttttgacctgtacttttaaaagatactattttaaaaggacaccattgtaggctgacatatcttaagctcgggatacttatgtagactagtgagtctgtcattgatctgaattttacttttttctgaattttaaaacagcagctgtagaactagatttggcccactacaaaagactattgtttcagttctcagtgagcttgcttggtctacatgtgaaatgataatacagaatacatgcatcatagcgaaacccatgaacatacaaagatctcttataatcagccatgcacaaaataagacaaaaatggttataatttattattttatgacatttaaccacgctttaatgtcagtgaccagtgatctattataaagcaataatttgtttcatatggcttagaccaaaactgaatgtagattattcctcgtcctctagatttatcacttaggggtaatatgttcatggaagtggaaagaactactaacatggacattaagaagaacagaggaaagtcttgctgcagttgatatccccttaaatgtctttctgccattttacctttcttttttggttagctttattaagatataatttacataaagtaaaaatacagactttttagcatgagttctgataaatgcatacagttgtgtagcctccatctcagggcacagaacagatccattatcccccaaaattgccacataataccccttataatcagccccctccaactagtaatcactgacttgttttgtgtctctataggtttgccttttccgtccagtttctttgactcagcataatacctttgacattcatctgtgttgttgtgtgtataatagttccttccttttgttgcagagtagcattccatggtgtgggagtaccacagtttgtgtttaatgagtcactcattgaaggacattggggttgtttccagtttggggtaattttgactaaagctgttaaacatttgcatatagatttttgtgtgtgttcataagttgtcattttttatttcatcttggataagtaactaggagtgggattattgggtcatatggtaaatgtgtgtttaactttgtagaaaactgccaactgttttccaaagtgatgtactattttgcattccagccagcaatatatgagagttctcgttgctcctcatgcttgccaacagttagtcattagaattttttaaaaatattaaccattctgataggtatgtagtggtgtcttatcgtaggcctaatttacactgccctaatggctgaagatgttgagcatattttcgtgtgctcatcctgtcttctttggtgaaatggccatttgacttttaacatttcctgaggtacatcatcagtgtgatgctttcctgaagagtatgtgtggggaggagggggagcaagggagaaaggaagcaggaagagaaatggaaaagaatgtgtgttggtcaggagcctttcctaatggcatatatttttgtcactaaagcatttaggggacttttcttaaattttagctagaccttggaaacagtaagcaggtatagtaggaagaacaaggcctctggagccaaacttctggaatcaaagcatgagtctgtcacttactacgtgtgtgaccttgggcaagtaacttgctttttttgtgcctcagtttcctcatcacaaaaataaagataggccagttgcggtggctcatgcctgtaatcctagtactctgggaggccaaggcaggtggatcacccgaggtcagcagttcaagaccagcttggacaacatggcaaaaccccacctctaataaaaatacaaaaaattagcctagtgtagtggcacacacctgtaatcccagctgcttgggaggctgaggcacaagaatcgcttgaacctgggaggcggaggttgcagtgagctgacattgtgccactgcactccagctgggtgacagagtgagactctgtctcaaaaaaacaaacaaacctacttcacagggttattaggaagattaaatatgttagcatctgtaaagtattaggacaatacttggcacatattaagctttgtatcagtgttaactgtcaatattgttaccctcacagtgaccatatttttcagttgaaaaattagggtttgtttttacatgtttccaagtatgagggatggttgtcatttttctctgccttaataatggaatttttaagatgtttgagtggttaagggaggcagcagagcaatttaaaatagataccattctagaaaatctagcagactgtattagtctgttttggcactgctgataaagaaatacctgagactggacaatttacaaaagaaagaggtttaattggactcacagttccatgtgactggggaggcctcagaatcacagtggaaggcaaggaggagcaagtcacagcttacgtggatggtgggaggcaaagagagagcttgtgcaaagaaactcccgtttttaaaaccatcagatttcgtgagacccattcactattacaagaacatcacaggaaagacccgcccccatgattcagtcatctcctaccaggtccttcccacaacacatgggaattacgggagctacaagatgagatttgggtggggacataaagccaaaccatatcacagacctactggatttaggcaaatttgtttttgtttttttcaatttataagctgaggtgtgaatatcaagaacacttaatacataatagtttaaatgccccatttgttatagtttatggttgcttttgcttttatcattcttctttggtctcatctactttttggaaaacaaattatgtatttgctaggaatgcttttttttgatacgattgatttaaccttttttttttttaagacatctacattagatttataattctgagccttacttgatgatgtacggaggaaaatatctgacacttcttatttctctaagtcttatttctttttgggatttttaggttgtggagatgttggaggttcccaataaacccacacaactgtcgtacaagtactactttatgtctgtgaatgctgcagatcgtgaagacagccctgcaatggcattgctgctgcagcagttcaaggaaaacattcaggacttggtttttcgtacaaaaaccgggaaacagaccagaaccaatgccaagcgcaaggtatgattccatatgaaaatgagcacagaatttgtgtgtgttaacttggttgtgttctttactcatttttaatatgagaaagaactaagatacagtttttaagagacgaggcagcaataaggcttaagtaacaattgtctacattttcttgaaaatgcttctgttttaattaaataattgtccaccattttccatgagagaacttgtgaaacacaaaatatttactaataaattaccagtgtttaggtcagtatttactcagtaaatacaataacatttgttttggttaaccctgagctttcttccagtattttaactatcttaatgaattgcatcacatgtacttttttttttttttttacctgtttgtgttctttacttaaattctagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggaggtaagttttttggaacagttctggataccccaaatgaaagagtagtttttaaaatgtgttgctgagggtatatatagattccattaggaaaagcagaatgtttgtgatcctgttcattttgggaggagtggtagggttacaatcatagcatctaatggtatacatgtaaaacatgacttgaattatttcatctctctgattccagattctgggtcttctgctctttatggaaattgaatgtaaaattttcccagttaaaaaaagtggacagggctgggcacggtggctcacacctgtaatcccagcactttgggaggccgaggcgggtggatcacttgaggtcaggagtttgagtccagcctggccaacatggtaaaactttgtctctactaaaaatacaaaaattatccgggtgtggtggcacacgcctgtaatcccagctacttgggaggctgaagcaggagaactacttgaacccaggaggtataggttgcagtgagtcaagattgcaccactgcactccagcctgggcaacaaagcaagactctgtctccaaaaaaaaaaaaaaaaaaaaagattaaaagaaaaagtggacaggctgagtgcagtgactgatgcctgtaatcccagcactttgggaggccaaggtggaaggattgcttgagcttaggagttcaagaccagcctgggcaacatagcaagaccttgtctcttttaaaaaaattaaagaaaagcaagtggacagtttttaagaattaacattttacttttatacctcttagtaggagcattgtttaagcctattagagatggttagttgatagccaggtggcttatttttgagttggtaaagccatgtatattgattaagccctagtaaaaccgggatcctttctaagaagcagatcagaaagaatattaaactaaatttttacttttctcacatgggagaagcaatagatttatgcagaattagtgccttgaaagaatacgcagttgtgatatccaatataatcctcaaacgtgaaagggaggtaacagacctgcactttttgtatttccaaaaaggagtttggccaaggatgggtagcccctcaaaagtgatacactaaaaccccagttatttccctgtaggttaaagttttatgttttgtaagaatcccctcctctgtaagttattgtgaatgaaggagagacctggaaatgtgaaaatggactttttcagttgggctgatgatgatggccttgggaagatttgttgaaaatagctttcatgctttagaacagggattgggaaactttttctgtaaagagccaaatataaatattttagactttgtcggtcaagtggtctctgttatagctactcaaatctgctgttgtagtgtgaaccagccagagctgatatttaaacaaatgagcatggctgtgttacggtaaaaaacttcatttacaaaaacaggcagtgggccgggcacggtgactcatgcctgtagtcccagcactttgggaggccgaggtgggcagatcacctgaggtcaggaatttgagaccaacctggccaacatggtgaaaccccgtctctactaaaaatacaaaacttagtcaggcatggtagcgggcgcctgtaatcccagctactcgggaggctgaggcaggagaattgcttgaacctgggaggcggaggttgcagtgagccaagatcaagccactccagcctgggtgacagagcgagactccttctcaaaacaaacaaacaaaaaaaccaggcagtgggctggatttggctcatgagctgttgtttgccaactcctgctttacaggaatttgggatctgtaggcagaggataaggtgtgaaattgtaaagagcccagagagaaacccaagcctagaaacaggcacctaaaataaatactcatgtccttgatgacccagctcctagaactgtgagcctgatgaatgtcctcttatctggatactggccttagctcctaaactgtggagtgtgtccatgtttcctatgtaattgactgtgttcttggactcttttattgtgttatttggattgattatatgaatatcattcagttactacctttgcagtgggaagggaagatggatatgtggtgctgaggcaaagcaatgcatttatatcctctcttcccctacccacaggccagaattggcaaaaatgtgtgtctttgtaggcctacgtaggttaatgactgtagacatacgtcctctctgtccaccttctctgtattcctatacctgctgcacatatgggacacagatgaacattctgtagttctctattgaactcagtcaagctcttaaaaacttacctactttttattctcagtgaacattctagctatgttaaagataaaagcaagtatattttctgcttaaagtaatttaggctgagatgtgaataactaaaactaaatctcatcttataagggatgtttatatatcttttttttttttgaaatggagtttcactcttgtcacccaggctggagtgcaatggcgcaatcttggcttactgcaacctccacctccctgattcaagcgattctcctgcctcagcctcccaagtagctgagattacaggcatacaccaccacacccagctaatttttgtattagtagagacggggttttaccatgttggctaggctcgtcttgaactcctgacctcaggtgatccaactgcctcggcctcccaaagtgctgggattacaggtgtgagccaccgcatctggccggatgtttatatatctgattgatagaatagcagcaacatttttgagctggcccacacttcatttccttttgaatctgaacccctacttcctatttggtagcagctatttttctaaacctttccctttcccaggcccaaagagcagggctcactcaaatacctggaacttccttaaatcctttccagaacatggtagatataaatagtctgtcatgcaagacctgggaatatctgccaaaggcaagcatttctttagatcagatgactttctggcatactgtaattacttgcagtcccatggaaagggtttcaggcactatctctgcatttatctttttaatttgctttctgaatcctttaattgggaaagagatgtcattgggtaaatgcacaaattggaaatcttttcttgggtttcacataggaagtagtttaattcttaaaaatgtatttcagaaatgttgtaaactaaaaaatatcatttagaaataagctatgacagtgactcaaacattgttttgaacaaacagaagagaattacacgagaaaccattcttgtggcctcttgaactactaaaattgattctagattacttttggctccctgcaaaaattagactaatctcctaaattttgaatatttgccacttgtggaggtgtttcttaaactagatgcactgggacagctttgagttccactggacttcatgtcgtttcccagggaatctaatgatggggataatactcatgcctaatatgttgtaacttggggaaaggatggtcctagaacaggtgccacaagaatagagaccgtagtacttagaaatggtagttgtttttgtaaaattggtcgtctgatataattgtttttctctttctagttgtccaatctggagattccacatcaaggagtgcaagtggaaggtgatggcttcagccatgcaattcgcttattaaagtaagcccctgtcatatgtttcacttggtgccacatgttgcagtcacactctgaaagctgcttctctttcatgagacaacataaagcagtgttcagaacctgtgggtgttgtggatttctgcatagagttactagggtctgggggaagattcctttaatctatggagtggcaatccagcatcacttggttttgttttttttgttgtttgtttgtttgcttgttttgagacagagtctcattctgttgctcaggttgactggagtgcagtggcatgatcttggctcactgcagcctcccaacctctgcctcctaggttcaagcaattctcgtgcctcaacctcccgagtagctgggactacaggcacacaccacgacgcccagctagtttttgtgtatttttaatagagacggggtttcaccatgttgaccaggctggtctcgaactcctggcctcaagtgatccacccacctcggcctcccaaagtgttgggattacaggcataagccactgcacctggcctcacttggtatttttggatgtcttttctctgcatttctttgattcgttcagcagatatgcattgagtgtgactgtgtgtcaggcttgaattctgacatcccctcagaatgctgtgggttcataaagcagaggaatatgggctagttcagaagtcaggaagggtatccctgaggaagtaccagttatacttggactgaaggagaggtgagaattagtcagaggaaagtggggcagaggcagtgggaggtcctaaccagagggataactgctaatgtgaaggcttggagggaagagagagcttggcatttttgtgctgaaaggagttcggcatggcaggagatgggagaaatgaggctggaaatgtacgcaggaaggggtcacatcctttaggcctatgtaaatgtccttcaacaatttaggctttatcctaatggcactaagaagctatcagatgattttaagctaaaactgacatcattagataggtgtttttgaaagctcaacctgatagcaatatggagaataaattgaatgggaacaagactaaagtaatgaaaccacttgttgaagtggttcacattagagttgttggtagctcagagtagggtacgttccacaaggagttaggagagaaaatattcacgagttatgattagattggtgttgaaggtgagaaagaggggaaagtggcaaagatgattcttggttttatcttgggcaaatgatggatggtggcagtgttttctgagatcagggacaccaaagatgtgagtttgaatggactttgctaagtttaaggtgcctgaataccctttgggcaggcagagatgtgtttcaagctcaggtaacagatctgggaaggagaagtagataaagtcatcaccatggtgatagtaattgagctggggtagtaaattagatcaccaggaaagagtatacagaaggagatgggcatagggcttaagttctaatggacaaaggacgaggagccaaaagatgcttagaagtaaagctaatgtggtacatgtgctttaaaagtgacccagtatggacttgcaaagccagaataccatctaagagatcaacctttttggtccaggaaacaggtttctttgcaaaggaggggtacactttattgtttcccagatgttgcttaatgatataaattatataagcaatttttatttattgaattcctctgtctgctaagacatagcagctctgcaatttgagcagtggggctttaccatttgttatctaggaatctgtttccgtggaaggtagatagagctagcaaatagtgtcacataacccatgtgtcattagtgctcactttagatactacagaattgaactagaatagttcctcttcctggctatcttaacaacatttccacaaaaacgttttcaggagagagagagctagtcttaaaatggaaatcagtaggaaaatgcaatacttccaattgcatttggttttgaattgctttgccttgaatataggttttttttttctttttactcttctaggcacctgtagataagttgataatgttaacatttgcattctattctcttagttgtatttttcatggtttgtgaaattttaaaaatatcttgttctcggcatttttacaagagaaatttcagtctcctttcttcttgaactcaagagaatgcgtaagagtcctacctaggaaggaagtactttatattttttagcttcattttataataattcttaaagtctttaatcttggcttttgttttctttattttaaaatgtaaaggaaaatatacataaacggatatgttaaagatgactgttggtccagtaagtgctgtccattattggggtagggtatagaagtgaagaagaaaaaaatgtaaataataaatgtctcaacatgattttattaaaatcctatatagacctaatgagtatggaattggactcatgcatttattctttagaaactcttgtaacaagcttttagttctggatatattaatattgaatatgaatatgagttgatacttcaaagctttaaaattggcacactttccttctctttgccaaaaatacattctgttcttgttctactttatccccttgaaaatttgttaagcaggcctccttgatgcatctctgcaatcatagtatcaaatggatcatagtaaatttctttgattgctatgattcatggacctgttgccttgtgcaaattcaagagccttgatcctataacccaaattaggattgggacacaagttttgagagagcagcatgctcatggtgcctagttttgaacgcttcagcaaacttcccaccttctcgttgaactcatgtcacagtcatgtgcagtagtaaaggtcctctggccacacccacgagggtttttcatttcctccattttgtttctttgcctcctgtagcttatgctgataatgcacaggcacagctctttttttgcaagttgtgcagcccagcttgtccttcatacacgtgtgcaatctttataaaaacctcttcactttccttttaggcacactcatgctgcttttgctagcactgtcagtgatctccctggttttgcactgcagggccatagtggggttaatgatgtttgtaaaagccctcacaacaaagctgacacacatctgccagaccttaaaagaccatagcctggctcctcaatttgtttagtactgagaagtacaggagaaaagttggttaggagcagctgtgtaaatcaaacatttttgaattggtaaaaattttcagataggttaatccattgtccagaaaataccttcctcggttcttaatttttaggtactataatagtattttgcagtattttaagtttgtaacaattttgtcaggtttccttttggggaacctggtttcgggttgttgcttttttcccctcacatgatcatgctgggaagataaaagttacagtttatttttattcattctgttccattcataaccttaaaagcaagtaactattttacgaattccttgaggtagagctcattgtatctgcatcacagattaaagtgatatacagtgcactttcagggttccgctgtccctaagagcataaatgggaaaagaggcttacactgatgttagttctcacttgaacacatgctggcttctgtgctttccttttctaactagatagattttgtgaaaaacctgttttatttgaaaggaagataatgtactgcatttatattttcaaacttgagatttaaaaaatctgtctgaattggctgctttataactcctacggagagggctatgtcgtgaggggtaagggcaggcaagtcctcagtatacctgtcacgttgaagaacggataggtagtttatgcaatttctgtaataactacccaaaatacagttgcacaaaatctttctggcagtgataaaaagtatgtagtgtgaaagattaacttttgaaaaacttcaaaagctgtatattgaagaggagctgtgatagaagttttaattagcacatgcaatctattttttgctctcttaagttgtttattccaggtcagtggttctcaaccccagggcagttttgccctgcaggggacttctggcaatgtctgcagatgtttttgatcattaactgagaagagggagtaggaagtgctactggcacctagtaggtagaggcctgggctgcacaagacagccccctcaccccgcaacaaaggattttccagccccaaatgccaatcctgccaagactgagaaactttgttatattctgaattaaggggtctgaaccaagattctctaattccaattatatttgttgtttttttgcctcaatataaatatttattataccaaatctgagaattaaccaccttctgtatgagttaaaggttatatataattaagtaatctcattatttcatctcactgaaataactcatgaatagctaaaatatattacctcatcatgttttatgaccaatgagatagtttgtaaaacggtagaaggaaaatggataggtaggtattttaagacaccaagctactacattcctcttgtatatgtgatgtatgtgtgacaatatgtatgttaaatgagttaacacatgtaaagctctatgaaaataagagttacctctacagaggaggaggtggcaaagtggggataatgaacctggaattttatcatggttattcagtcagtgaccaagatttggttttactgcaagggagaattaacatacatggggccaggcttggtggtgtgcacctgtaattctagctactcgggaggctgaggtgggaggatcgctcaggagttcaaggctagcctgggcaacacagcaagacaacatctcttaaaaaacaaaacatatgaatacttgctgtgtcagccaccataagcactttcattttcttcgtcaatgacacataaggtaattcttcatctctattttgtagctgggaaattcagagacattaaatgtggctgagtcagagttagaatgtgggtctctgactccaaggcccttattctttgtactatatcattctgtcttcaaagagtggttttataaggatttggtccccttagcttttccttgaggatgttctagatagattttgtagaaaaccagtattcttgattttcattctgtagaattgtagtcttttttaaagaacaaaattatgaataaagacaagcatcactgttaaaatgagagttctaatccatattgatgtgaatggaaatggattaaatactattaattgctgtgaattgcttcctccttttgcagaaggtatctagaagtggagtttgaactgaagctgtaatgtcataccttgtctgtcattgtgtacattgtgctttgtctgtgtaaagtatacttcatatgctgtcttttatcaccagaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggtgagatgtttcacacattttgtctttgcatatttctggatttttttggtatcgattactattaatattctcttttaatcctgtaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccaggtacgtgtggagataatctcctttttaaataaattaaaaaaaaaaagccctcaccctttttttaactgaagtgaaacatgcacagtgttccaagcaaaaaaatcaaagtatatctaataaaacttaagtattcctttcacttcagacttcaatttccttcccctaaagacaaccactgttaagtttcttttgtttgcaaaaattttacacacaggtataccatatcataataatagtgcttatttactgtgtggcatacaatattataaacagtttgcttgtgttaacaaatgagttttcacaatcttcacaatcacaatcatgagggtaggtattattcctcattttacagaagaaaacaagttgcagagactaagaactttgcataaagtcccatagctagtgagtggcagagttggaattggaaccctctaaccactatgctagactgcttcagtatatctcacctacccttgcccccttttgtagaaacggaagcatattatctgtttgtgctgttgctttttttaaaaaactaaattacttaactagagacctgtctgggcatataatattgccaaaatgccctgttactcaaatttatattttaaaattttacatgtataatattaatctcctttttgtttccttctgtttagacatacctgctcatctaaatattttctcagaagttcgtgtttataattaccgaaaacttatcttgtgttatggaaccaccaagggaagctcagtaagtctgattaaaatgctgaagttcctgtcttatgaatcttaaaaatcaagaattaaaaaaacatgaaaattaccttaatataagtaagagctcaagtaaaagttagggataaaatggtaaattttaaatgctttgtggctataaatatagtatactataatgcttaactctttaaaattgaaaacaaaaataataccctatgatggggtatataatcttgaagcaatttggacaaggtaatgtactgatggtgtttgtatttttttcttcactgattacagatttgcttggcaatgtgattattgtaaggaaaattgtgtatgagtggttataacaatatggtatgtttttgcttttggtcacatgaatgttaacattatttcatcttaacttaatcttgaagtatttcctgtaatctatagttctttattttttttcccacctcatatgtaaagtcctagaaatgtagtataaaaatgcagccagctggtttctctctagacttctacgtcaagtaatgtcaggttacttgagctttttaaaatctgttaaccaagtgtatctgtgtccagagtggcgcccttcccctttatgacagtgctccttagttgatggtaccaaaagtgtgactcttcttcagttcaagagaaaaacgaaaagaaacactaatgataattttcaaataaagtttaataaagttgttttagcgcctttctgttttatttagtaaaagaggactaacacatggtcagggagtgtactgttcaatattaacagcacatctggagttcgaatccagtcttattttattgcttgttttccaaaaaaaaattccatttagatttttggcgttttgccttacttttaacattttttttttctcctacttgaatctgttactttctcagtttctgaaacatgtaatcttttttatttagattagtatccaatggaattcgatccatcaaaaattccacatttctttgggaactgttggcccaaactcaggttgcagtaactgtcacaataccattctccatcagcttcaagaaatgttcaacaaaacaccaaatgtggttcagttattacaggtaattaagtttattttctgtctaaaaataagacttagtatgccagccgtgctggttcacacctgtaatcccaaccctttgggaggccgaggcggaaggattgcttgtgctcaggagttcaagaccagcttgggcaatgtggcaaaaccctgtctctacaaaaatacaaaaattagtcagttgtggcgatgcacgcctgtagtcccagctacttgggaggctgaagtgggaggatcacctgagcctggggaggtcaaggctgcagtgagcggtgattgtgccactgtactccagcctgggtgtcggaatgagaccctgtctcaaaaaacaaacaaacaaaaaacagcatttagtgtctcaggcaaaactcttcaaaagatcatggggacttgtctttaatgactaaggctgataattttgtcttttatatcttgaacacttctttgagaattttctttgattcagtgtggacccagtgatctagtttgcattctcttcaaggggaagttttatggaatgtgccagaaggacgttgtttcatttttgacagttatacactgaaaattctgaggttttaacatttgtacagaaactggctgctctcactgtgtttgttccttataggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaaggtaacagactttagtgttataacatgagtaaacataaaaattatctctaaaatagtttctttgagggggaaataatggggaaaagcaacaaattcctgtttaaatttagtaagtagcagtgttaactcatcatctgtataacgtcattctgaaggagctagaagttctgataaagtgttgtgcttatgtgtatgagatgattaaaagtatttttctttatattcttaccttctgatcagtagggtgaagatactaaaaacaatttgtgtttggtctttggaactttaaaagtagtttttatcattgatttttgaaaaggtttggtcatcaattctactgtgatgcttatttatttatgagacagagtctcactctgtcacccaggctggagtgcagcggcacaatcttggctcactgcaacttcagccatgtgggttcaagtgcctctcctgcctcagcctccccagtagctgagattataggcatgcaccaccacacctggctaatttttgtatttttagtagagatggggtttcactatgttggcctggctggtcttgaactcctgacctcaggtgatccacctgcctcagcctcccaaagtgctgggattacaggcgtgatgtaatctgtgcctggcctgatgcatttaaaaaatgtaaggtcctgggaccctcccaaagtgctagaatcacagtaacctgtgcctggcctgatgctttttaaaaatgtaaggtcctggaccacaactgccagagtggttaactgatgtgatagctcagttgtatgtgtttttagtctagagtcaaataaatctaaaaggcttgatttgaaaaatagtctcctgcaacccactcttgtcattttcttgctccccagatgccttgttttcagttcttatgtagctgattctcttggtatttatatctttatctctaagtagaatgcctacattgctatttgtttactttttggttgagggcattatctgattctcacaatggaagatgagtattcttttttctattttttttttctgtttttcttttctttttttggagacagggtctcgttctgtcctcctggctggagtgcagtggcatgatcatggctcactgcagcctcaaccaccagggctaaatccatcctcccacctcagcgtccccagtagttgggaccacacccggataatttttgtattttttgtagagatggggtttcttcttgttgcccaggctttaattcttattaaatttttttttatgtgtgctttcccccttccaggctgctctcagtgcataaacacatttgtctttcctcctatctttgtaacatggttaggtagcaattttgattagattatttttcagcatttgtgcagttatgaatatgtaagcgctgctgcaaccaagcttactatgattatttttcctgtcttgctcaacattttattttattgggaattattaattgggtcttttttggtttcgctttctctgtagtacctatcactaattaaccttaaactcttctcctagttatgtaactccttttagtatgttcaaacatatcaagataacttattgatttcatcttgaagaaatctcttcaataggcctctgacctgctccaatttggactgatagcagtctgggctttctacacagtgttcacttaagaatctgcaaaaggatgaaaggggagattccttcatttctcttttatgttgcacattgcatgccttgtgtggtgggcgccttgttttttttcttggtttacttcattgttttgattactgggagaaggtacatggggggtggggaattaatttgaaatcacatatgcctgaaagcatctttagtttaccctcatctaactgaagtggctagataaagaactctaggttgcaatcattgtctgtaaaaattttgaaggtactacttcattgtctcctggcttccattgtgactattgagatgtgtaatgagttcacactgttgaacattatgtgacttgagtgggctctttctgtctgaaaacttaatatccttttgctttgggaaatttccttgcactatttcttggttcatctccattgttttctctgttagctcgttcgagtactcctaatgttctgatgctaggcattgtggacttgtcctccaattttcttatttcttttgtttttttgtctcttttttctgggagatacctcacttttttcctctaatccctctattttttatttctaccaatattttattttggccattctttaaaaaattttttcaaaaggttttttttgtttctaaatgtttattttaaacattctattatatggcaacattactttttctttttatcctacataatctctattttattcaccttgcttttgtgtgtgggggggtgtggtattgatttcttttatattagtgtctttcctcaaatgttaagcgattcttaactctctgctcttatttaaaggtaagacttattgactgtggtcttcattgcaggatgatctccttgggccatttctttgggaaactcccgatatcagtagctttaggtctttttgttgggctggtgtgagtaccaagacaggagtatccaaatcttctgcatagatggtatgcatcttgctttcaatattgggaaagtcaaatgaaaaaacgagtattctcaaatttatgtagactttgatccccattttttatatagtagtccttctctgagttggtctttggcatccctcaagtcagagatcctcctccatggtggaagagataaccgagctcagtgagaatagcagaggatctgggagggtctaagtgtctcttagactttcacttagtccttctgttattagtcccacttttatccccacttccaaaggtacccatattagtctgttttcacattgctgtaaagatactacccaagactgggtaatttataaaggaaagaggtttaattgactcacagttccacgagcttaacagaaagaacggctaggaggcctcaggaaatttacaatcgtggtggaaggtaaaggggaagcaagcacgccttacatggctgcaggggagaagcgtgagagcaggggaaactgctacttataaaaccatcagatctggtgagaactcactatcacaacagcatggggggaactgtccccataatccaatcaatcggtccctctctcaacacggggattacaattcgattacaattcaagatgagattcgggtggggacacagagccaaaccatatcagtgcctgatactgccagttccaaagtatctcagggatctggatggaaatagcttgcttcttggcttttcccacagcttacttaggatacaactttctcacattggatggttctagttgctactcagccatctgctttgcagcctcccggatgtattgctgtttcttctcttctcctattctttttgtctttgttacttattgcttcaaaaaattctttccagtagtttagtggggaaagaatgcaatgtgtgttgtgagcccatcatctttaattaaaagtagactgtagacttcttttttgagacagggtctcactctgtcgcccaggctggagcgcagtggtgggatcacggctcactgcagcctcaacttcccgggctcaagcagtcctcccatcttagcctccctagtagctggatccacaggtgtgcaccaccatgcctggctgatttttctattttttgtagagatgaggttttgccattattgcccaggttggtctcgcaagggatcctcccatcttggcctcccaaagtgctgcgattataggcatgagccaccatgctcagcccactatggactattaatagctctctagtgattctgataagcttatgattcaaatatgtgtatattcgaatactggggatgtgaggagtgttaaagagaatctgtgcttgaaacacaaactctgatagctttgctcagttttgacaatatgtaaaacaaggctgtcccactcttaatggttcaagattaaattatataatataaaaaaggaaaaaattggatcgtttcttactcagttttcctttcatattttctagtttaaaaagtgagatggctcactagctgggaaattttccaagtcattgaagttatggccaatatgcttttcattttttacccccatttctggattagaagttaataagaaaatattatgatctgatggtaagaggtgccaggatgtacttctttcttcaactttttgctcacacaatatttcttagtcaatatgactttttttagatgctgtttttgttaactgttttcctcagtttcccgcttcaaaattaacaatatttcttctaggttgtcctagtaacgatcttcaaggatcaacatactgtgtttctgtttaaatattctaaataatttaaaatattttactaataatgttaggtaaaataatctaaattttacctgtttatatccgtagacgttcctgaatatgtttgttgacagcaatcaggatgctcgaagaaggtctgtaaatgaggacgataatcccccttctcctataggaggagatatgatggattctttaatatcgcagctccagccaccaccccagcaacaggtaatatctagccagaattccaagtggtatcacatttctgtaacttcacaggttctataggtgtcaagacttcattgaaagacaaggaggtccttggtgggcctgagatgcccaggaaatacttatgaaataaagagttacagaaggaggcgaggagacttccagtgacaagaaatgaatagtgttggaaacagcattaatctcaggtcattcacacacttaaaatgatgttatatgattccagagatggaaataccatccgcaggatctgagatctttgagagagtttccttaccttgtcttgaaggacagatgctattaaagtagagcacagtagactaaatgtctagcgatgttcagtagggactcctacagagaacaggtggacaaattttcagggttctgtcctcaagaccatttggataagccacattatagaaccataagagctttcagttctgtcctgtcaccttcacatgtctgagagttgaacaggcccctaggctagccattgttctctcactgaccctcctgaaatagaaggtgaacagtgattgtttagcccttcaacagtcctttgtgactccctagtctggaaaatcctcaatggggctgtagactctgggccggagtcttcaggggcttcatttttagttgtatatgagcacacagcctgtaggcaaggctctttggcacatcctttagttttggtttacgaaatagctcactgcttctcatccagaagctttcatgaataacattgcttgaaaccagcattgtgcagagaatcctcttagcttattttattgcttagcttctggtctggctacttagtgactacaactttccagtgcttaaatctttgaaaaagtactagattcttactagaaggagggttttgtggaagctgtattgttcctggcagctatttagggttacttgccttgtcactgtttcccttcttggccttcatgtagaacagggaagctcagtaaaggcctatgcgaatgtctctgtgtagccgaggtgcggggctcttgtgacagacattgactcagatgagatactagccctttgaagatgctgggccaccatgggagagaagtaccttggcccagcggatatcagagcagcttttttcttgtggaagccactttcttgcattttcaatctttcctgtacctgatatggagcaggggatgagccacatcctttgggggaaagaagtaactgagttgggctggctgatgaccatggccgtagcagggccaatgttatagggggaatggagggagaatgtggtccattattctctccctctcccaaaataagttgttcattggcccctctataatgatttttttttttttttttgagatggagtttcgctcttgttgcccaggctggagtgcaatggcgtgatctcagctcaccacagcctccgcctcccaggttcaagtgattcttctgcctcagcctcctgagtagctgggactacaggcatgcatcaccatgcctggctaattttgtatttttagtagagagggggtttctccatgttggtcaggctgatctcgaactcccgacctcaggtaatctgcccgccttggcctgccaaagtgcttttgttactgaaaaaaatcataatttgacacagtgagagcctgcagcgctagtttattagatattctgatttggctaagagcaatatacacccagtaacatttcatactgaacatgagatttctaagtaggaaaatagttgcaggctaaggcagaaggattagaagtgggtagattggccaaaggttaggatattctagaaaagttagaatgatttgtcactttgggaaaacttgaggaattttctgccttttcttgctctctattcaacctgtaggtagagcttttttgtttgtttgtttttaagttaaaaagtttgacacttaataccaagtcagaatccttttaaaagaatattcatctgccatggttaaatgtctttagttggtggctttggctttatgtacctcctaaagattgagcctttgattgagcagtttcagttttcagtttttttctgtttatcagatatctgtgctatgcttctatttgtaaactatttgtctccctgataagacagttgtgagaaaaaaatgttcataaagggattcatgtacattttacttgatgttagcaggtagcttttcttcttttatataaaatgcagttttagtgcataagctagtctatgagaaaggaaaggaagaaaatagaaaagcttatgaatatcatagttttaattaacaagttagtatggcttacatctccaaacataaaggtacattctgcattattggataaaacagtatgggcaaatatatgattttgtaccttatgagttagcctgaattctataatttctttaagatagcttagaaagaatcaataaaaaaaaaaagtagacaatctggttttaaaagtaggtaaaagattcaagtcatttcacataataggatgtccaagtggccaataagcaccgaaaaggtattcaaacattatttgccatcacagaaatacaaattaaagctacaatgagataacactccacacccacaaaaatggttttaagaaaaaaattgataattatttccaacatttgatattaggaacaactgaaactctcgtttgccactagaaaatatgtaaaatgttacaactaccttgtgatagtgataaagatgagtaaaggtcaggctgagctaccatatttcattgatactaaatgccaccaaatgtaagatgcatcagtttttatctaccgctcagaaagaaaaaacactgccagttaaactaacatcccataaatggaaagacacaccctgattttagagatattaaagtgtggggggaaaatgtcttagaatcaatgaaatggtagataaataatagagataaatcggttatatgctagatagaaaatgagcaaaaaacatcttgagggatagaaagcattgcaagatcgggaaagaggatgttgctattttaaaacatttcgaaagtcggggtttataaagacttgtgctggtgatgtgtatttattttgcacacttttatatctcatgtttcctatttggtaaccagcaaagtgtgtaaatattaacactgtagctataattagtgaaagccacactcttatgctccgtgcggttggccattttaccaacatttaattttcttcttttcagccatttccaaagcagccaggaacatcaggtgcttatcctcttacttcaccccctacatcttatcatagcacagtcaatcagtctccctcaatgatgcacacacagtctccaggtaagatattacttattctcttgtcatgttcaactttcaaatccaaaatacacacacacaccccacattgagaagcactgtgcatctagtctcaggcttcagagagaattccctttctagtctatggctagatagttgtcactcatttattatggaaggtttgtgaaatctgtgtccaggcttgggagcactttaaaaggtttaaattaatgtcacccagagccagactcacagcacaactccagggggtgctaatcacaacatgatctatgttacaggttgacagactctaaggcctatgagccaaatcctgcctgtcacctgtttttgtaaataaagtttcattggaatgaagccacacttgtttatataatgtctatggctgctttcccactacgacagccctttacagaaaaagtttgctaagccacggaataggtgaagggtggcctgcccccaagctccagagttaggcagtgcatagtctgcttgtccagacataatggctttgttggcagccctatgaagtgcaccgtaaaagtgcttgagaatgccaaatttttgcttttaactgaatgattcagtggtatctcttgagcacttactctgtgccaaatgctgcctggtgctgaagatttagcagtgaaccggataccagccctgctcttgagcttatcatctagcgaggaagctaggtcatcagatttattggggagaatgacccgttgcctactaggtcctagtaatatttccagagcataatgatgtttttttcaaagaaagttttagcataaaagatgtgatatgtaatataggttgtaaaatataagaaattaaatgatttttaaaagcatgtgtaataaaaccttttatctagtgtaaatatatcagtccactgaactaaagaatacattaagtagttttgtaccaattgaaggcattcgggcttatcagaaaacagggcaaacaaaactacgttaattttttaagtagcaaacccaacaaatacatctgcttttaagttttcactttgaaaagcagaatttgcagtgcatactgttctcctttattttttttatttttttttttttttgagacagagtctcgctctgtcgcccaggccggactgtggactgcagtggcgcaatctcggctcactgcaagctccgcttcccgggttcacgccattctcctgcctcagcctcccgagtagctgggactacaggcgcccgctaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctcctttataaaatacaaaaattcttatagatatgtatatgtgtgtctatatatgagaaatttgtattgaccagagaatctgttaatctgcaggtgggagatgtagtgacatcacttattcaatagctaattccatttgtaaaatgagaataatataaaaccttttccatagagatgttgtgagaatcgaatgaaatagttcacataaagtgtttagcctggggcgtggtacatgacaaatgcctctttgaccagtccattgtaatctgtcttgttgcccagattgggctgctcgacatcccacactgcctaggcactcacaccctggcagatcccacccccaccatgtctcacacttagccactcatattgctcttcacattacttcagtggtgtcgttttaaaaaaatagatcctcattttaaaaatctttaaattcacttttatttggggggtgggttgtgcttcctctgcttagattcctagataaacagtcttcatctgtaatgccaagtatgatgagtgttacaaaaagggtcacttgggcttctgaaagagcattcgataaggggggttcgattgtttctttcttgaggatgcgttgtttgcctccctcctttcgacactggttaagctgagacttgaaaggtcaagagttacccaggtgcagggacatggacaaggaggatatctcaggcagactgtgcagggtgtgtggagtctgaacttccagaagatggtagactcttccaaatggctggtgtatggagagacagggcgctgttaacaattttggcctttattgtatgggtaaataggaagccattgttggattttagtctgggttaaatttgtacaactgaaagtgacgagtggtggacgggcagatttcacagagaaaggaggggggagttctcttgaacctgttgattttgcaagtccccagagattactaagtcaagatgtccagtaggcagttggctgtatgagcctatggctcatcagagatggttggaccacagatgaagacttggaagttgttgttgtcatgtctagggtcattgaagcccaagtgggtggttgagtccacccctaggaataccagtggtcagtggggaagtagcagctagggaggaagtagacaaaacaggagaaacaggattgtagaaccccaggggagtgtgtttctaggataggagttgacattgtttttatatagtaggaagggaaaaatattttgaaataattataatagtggtagacaagcatatagtgcttactatgtgccaagccctattctaagcactttacccgtttaatcctcacagcaaacctgtggtgtaggtcctattattattcacattttatggaggaaaactgagacatggggaagttaggtcacttgtccagatcatacagctaaataagtaaacataaacacttaaaggttagtcaagttgatcaacatactgattgaaagtaagacagtgctttaggtattacagaacacaaaaatatgaaattatctcacatagtacagtcccccctcttattgctctccaaggttttagttggcctgaggtcaactgaggaccaaaaatgggcaagtatagtacaataagatatttagagacagagagataccatattcacataacttttattacaatctactgctaagagtgttctattttactgttaatgttaattttttactgtgcttaatttgtgaattaaactttatcatatatgtgtataggaaaaaaacaggtttcaatactatctgaggtttcaggcatccactgggggtcttggaacctatcccctgtggataaggcggggactgctatagtagagaatttgaaacatgctgatattaaaggtaattatgataatgtagcaagtgcttaaatgttgcatttattcatagttttggtagccatagttcacactttcataatcctaaattaaaactagtcctgtgcctttaaataagttaacgtttcactgttttttatatctccaatctcagtctctccataagtctagtattgtattttcttttttctttgattttttttttttttttttttttggagacagagtcttgctctgtcgtacaggctggagtgccatggcgtgatctcagcttgctgcaacctccgccttctgggttcaagtgattctcctgcctcagcctcctgagtagctgggattacaggcacatgccactgtgcctggctaatgtttgtatttttagtagagacggggttttgccatgttggccaggctagtctcaaactcctgacctcaggtgaaccgcccacttcgccctcccaaagtgctgggattacaggcgtgagccaccacacccagccttagtattgtattttctagctgtctattcggcatcatttccatgtaatgtctggtagatatctgcaactcagcatggccaaaactaaactctggatctcttcactgccccagtgctcctcttcccacagacaccccagctcagtaaatggcaggcccttccttcctgctacttgggccgaagctcttcgagtcatgctggacgtctctttcatacccatgttcggtcatttaccaaatactatcagcttgattttcagaatttacccagaatccaaccacttttcactaccatagtctgtcacctttaccaagccactagtcctctctcacctgaattattgcagttgtttctaactggttttcctgtccctacccctacccttgctctatagtctgtcccacagcagctagaatgatccttctgggacagaagttcgtccatgatttccgctccaaactctgcattggattcccactcattcagggtaaaccctaagttcttagagtggcccacaagtccccatgtgatctgggacccacccctcttcctccaacctctctggtgtcctctcttcccactgcccccctcgttcactctgttcttgccacaccggcttcctccctgataactgcttccacctttggggcatttgcactagctctctgtttggctggaatatctcatcccctgggtatcctcatgccttatccttcactttcttcacgtctcagctcacatgcccccttccttagagaggtcttttctgattgctgtatataaggaacaacacccacctccttcactacacaatcttgtccccttaccctgttgtgtttttttccatagcacttacctgacagatacttgtctttctcattctattagaatataagctttgtgagggcaggaatttttgtctcttttgttaactgctgcatccccaatgcctgaaacagtgcttggcatgaagttggcattcaggccttcttgttgaatgaatgaggaactgaataaaaagtacaccggatttttttttttaatcagtcaatataagagctagaatttgggcgcatggaattgaatagtctctttcaataatgaaatcgtgccagtttttctctgtgttatatatatgggagctatactacttgtttctttaatttatagggagatttttaacttggggtccttggacaggacataaaatgtgtcctgcaagattatctataattattttcctttattaggaaatctgcatgctgccagctcccccagtggggctttgagagccccatcaccagcgtcatttgttccaactcctcccccatcctcgcatggaatctcaataggaccaggggccagttttgctagtccacatggtgagtccatacatggaaatcgatatagcataagagcttgatgtgaaaataatttttgttgagtaaattttttcattgcaaaattaatacttgtttattgaggaagtagcaaaaatattgctcaagcaaaaagaaaatcaaatttatctaatcccaccacacagaggtaacgaccagtgagtttgtctctgccttggactctcccttgctgtctccgttgctctgccttgcccttcctgtcacacatgccctgcttgcctgccctctcacgtttctgttattctcacttgctgtctaccaagctgcttgtctcccccctcaaatacctgcccttgccccccaacaatgggtaccctaacatatgaattgttttgagacttgaattttttaacttttgaactcaaaattttattttgaattgattcaactagataaaaaatagaacaagtagtcaatgaaaggtttcctttttattccactaaccacctagttcctcttcccagaaacatgtagatattcttgcagagctgttttatgcatacacaagcaaatacatgcaagtgttctttcccctctcctttacacacacaacagcatactttacagtgttcagtgccttttttcacttaatatatcatgagtatgataccatagaacataaacaggttcctcagtttttaagctgtgtagcatctgggattttagtttttactattaatatttgtgggaacatttccgtcattaaaaactccacatcatcataccatatggtgtaataatatccgcttgtctgggcataccatgacttaactgctctcctattgttacatgtttagaatgtttccattttttcacaattaaaaatggtgccatctgtgctcatatccatgattatttccttaagtaagttccagaagtggaattgttgtatcaagggatttgacaaattctaaagctttcgaaacatataactgctcatctgaaaggctgtaccatttcccatgccatcatacaagaatgtctgttatcctgcatcatcgccagggagtattacatattttaaagaccttggacattttcataggtgaaaaatggtatcttactgtttaatgtatttctttattagtgaagaaaattgaaccttttttggttggtctttggtttttttgttttgttttgttttttttgagacagagtctcactctgttacccaggctggagtgcagtggtgcagtctcagtgcactgcaacctcggcttctcaagttcaagtgatcctcctgcctcaacctcctccccagcaaagtagctgggactacagatgtgcacaaccacgcctggctagtttttgtatttttttgtagagatggggttttgccgtgttgcccaggctggtctcgaactcctggactcaagcaatccacccacctcagccttccaaagtgctgggattacaagtgtgagccaccgtgcctagccggtctttggtgtttcttattttatacctcccagttatatatgctttgcctatgttcttgtgttttttcttgcccatttgtaagacctaagtaaagaccatttactctctgacatatacatggtaaaagtattttttcagtttgtcatttggttacagagggatataaataatatgttgaaggtatctggaggatgaaatttatttattttttatttttgaatatcttcgtagataccaatggagggtgaaatttaaatatcaaattgttcaggaagtcactgctttcaaaacttgagtcttggttcatttcttagtcaacgtagtctaaataaagaatatggaaaatttccttctcctcattctacttagagtagaatgaaaatatggtttgtcaaagttggtttaaaaatataatatttctgcctttaaaggaactctgagattgtttgcttaatattttaatgcatatagtagcatacattgttacatattacatacattgaagcttgtgtgaaggtaaattttatcctctctcaagctttatatttttctaatttttgtatcatgttaaaaagtaccttacacaaaatagagattcaggcatgacatgttaacacacatcaagcttcagtgaaacatcttattggaagaaaaaataaaattattactgtgtaaagatttgaatgctgtcaaataattttcagttattaaaatataggttttgagaatcatttgtttaccttttttataggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagtaagtatcatcaacatttttatgttcttttttagtataacccaaagtgacctatcttgttgcatcctcacatttgaaagtcatgacctactttttgagagaggatacttaaaggatattacaaaggatgcagatgaagagatgcataaggggagtgcagtttccatgccctctgtgagccttcacatgtttgcctatctggaagttctccaaactctgtccttttgggtttttatggaagtttcatcacgtaggcattattgattaaatcactggccactggtgatcaactttgggggtggggctgaaactaccaaccctctaattgtgccgtgtctttcctgtgatcagcccccttcctgaagctacctaggggctgccagccatcagccatctcattagcatacaaaaggacacttaaccactttgaagagtccaaaaattttaggatttgtatgccaggagctaggacaaagaccaaatatatatttcacaatatcacacataataacagagaagagaattgtacacatttattggttagcttttgctacatttagtggcttaaaacaatatatgattgttatatattggttcacaattctgcaggttggcagtttagactaagcacagctgagtgattctttcagactctgctgggcagctcactcatgtgtctgtagtcagctgctgggttggtttgggactagatggcctcagatggcaaggtttctctctgctttgtgtggtttcacacttgatctgaggtttgttcacatggtggctcaacaggattttaaggcagggagtagaagctgaggcctacaactagcccagtgtcacttccaccacattctgttggtcagaagcaaatactaggccagccaggtttcaggtggagaaatagagtccaccccttaaaggagttgctgcaaagtcacattgcaaggggcctggatataagaaggagaaaaatagtggccatttttgctaacaggttgttaatatatgattgttacaccacaaggagtaactaaaacagtacagaatgatttagaacatcaaagatttatgatgaaagcaaaacaggaagcaatgagatagtatgtatttgtaaatgacataacatgttttccttcccaaaaggttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacggtatgggtacctaatgaccttctaagtggtgattgttaagggtaaaatgctaaattgtcctgcaggataggatctgaactaacgtgacattccttcaccttccctcctttaacaagcttgttagaattatgattttcaccctaacctggcattaaaaatggactccattattttcttttccattcttatgttaacatatttctgcattatacagtttgctgtgctgtggcttctatgttatatggctaacatggacctggagatagatttctgcagcacacaggagcactgcgcacaggatctggccttgcagagaatagcataccagtaattatttgccttctggagtgcccgtgcggggaggctgattttgactctgagtctttattgaaataaaataattggctgggtgtggtggcttatacctgtaatcccagcactttggaaggctgaggcaggaggatcactgagcccaagagttccagaccaccctaggcaatatagcaagaccctctctctacaaaaaatttaaaaaattagcaggcatgcacctgtagtcctagctacttgggaggttgaggcaggaggattgcttgagaccaggagttccaggttacagtgagctgtgatcatgctgctgcactctgtcctgggtgatcgagtgagaccctgtctctaaaaaaataaaaagagaaaaaaaatttgaagaaaattatttatggttacaaggacaaaagcttctttttaaatatgtgaacaggacgggcacggtggctcacgcctataatcccagcactttgagaggctgaggtgggcagatctcttgaggtcaggagttcaagaccagcctgggcaacatgatgaaaccccgtcgtctactaaaaaatacaaaaattagccaggcatggtggtgcgcacctataatcccagctatatgggaggttgaggcaggagaattgcttgaacctgggaggcagaggttgcagtgagccaagatcgcgccactgcactccagcctgggcaacagagtgagactgtgtttcataaataaataaataaatgaacaattgaatttttaaaaactctcgtagaaaaaagacttctaaaaaaaaaagaagaaaagagacttctaacttatcctatgctgatagccttaggagataatttataattgagagcaccagttctacagtcaggctgcctgggtttgtagccagccatactacctgctaatgtgtgcttaggcaaatttcttcagataatagtatttacctaactgataacagttgtgtgaatttgagatagttcatgtaaagcccttaatatactgtctaggcattttcattatttataattactgttattattggtagatgcatgtgctaatgaggtagtcaaaatggtgaatgtttaggccgggcacagtggctcatgcctgtaatcccagcactttgggagactgaggcgggcggatcacttgaggtcaggagtttgagaccagcctggccaacatggcgacaccctatctctactgaaaatacaaggccaggcgtggtggctcatgcctgtaatcccagtactttgggaggctgaggcaggcggatcacttgagcccaggagttcgagaccagcctggccaacatggtgaaaccccatctctactggaaacacaaaaattagctgggtgtgatggtgcacgcctgtaatcccagctacttaggtggctgaagcatgagaatcatttgaacccgggaggcagaggttgcagtgagccgagatcgtgccactgcactccagcctgagcagacagagcgagactctcaaaacaaacaaaaaacaaaaattatctgggtgtggtggcacatgcctgtaattccagctactcgggagactgaggcaggagaatcgcttgaacctgggaggtagaggttgcagtgagccgagatggtgacactgcactccagcctgggcaacagagcgagactccgtctcaaaaaataaaaaaagaattaaaaatggtgaatgtttaaaatattcactccatgtttagtgtaaagccattttgcaaccttcatactaagatttggtggggaaacgtttttgaataaattagcattcaaaagaaagaaaaataataaaataaactaaaattagcactcaaaatggtaatcatcagacccgggatctagcctcagctatgccacttaccatctatgtaagctttcagctctttggcctcattttgctcagctgcataatcaacatactctgctaaaacgggtcagtaaactacggcccctggtgctatgtccttaccacctgtttttgtaaataaagttttattggaacacagccacacctgttcatttatttattgtctatagctgctttcagctgtgatgacaacattgaataattgtgacagagaccatatagtgcataaaacctgcaactttttctatataacactttacagaaaaagtttgtcgacccccggggctagaataagagcctaatccagatctaaccttttgtaattgtactctgtcttctttttttctaatgtgccactttaaaaaaagatattgtggaaaatgttcagcatatacagaagtagaatggtataatgaacttctgtactctcatcacccacctccaacagttaactaatatcagtattgtttcatctagaactcctccccccagattttcacagcaaatctcagacataatttcttgcataaaaatttttgcatatgtctctaaaaagtatagactcttaaaacaaaacaaaacaaaaaacacaacctgcaccattctcatacctaaaaaaaataatttctgtatcacatatctagttgatacccagatttcccaggttgtctcattttttacactttgaatcagaaccgaaataagtttttctaagtccccttacaacttttggttcccccatctagttctccttcttcatccttatgcaattcggaatcacttagtatttttttgatccctatgttttctatcacattggtcagtcctctggatcaaactactgcatgaattcaggctcaagtttttttatgttgttttgcaagaatacttcataggtagagttatgttcttccatcaagaggcacataatgtctgatcgcatctctttttgcagtgttgccagcagctgatgctcaatgctgtaggtgcctttgttttggaataggtatcaacttagtggttttccttttggaacaattctcagtaacatcttcattttctctttgacttacatgttaatttgatgtgtccttgttttgtagctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagtatgtgtttaatagtgcataatttgaatataattaatgaaacagaagcattaatgtagaatgaagagtaacttgctttatttatccctgtaggttgcaggaccaccatttaaagctaatacgttaatagccttcaccaagctattaggagctcctacacacatcctcagggattgtgtgcacattatgaagctggagctggtaagtcacagagatatacatttctagcaaggtttgtttgaggaggttagagttggtgggagcagtgtttattggttttcacccatctatgtagtttcttctatttttctcttaaattcttaatttttaacttaaattttatttatctttgaataggtaacacaattctgttttatcttttgaatttaaaacaagataatatagtgagaaatttcccatcagttcctgtctagctatccctgtcccctctatccctgtccaactgtcttctggccaaccagagttaccatggcttgcctctccttccagagatggtccattcataaaagcaaataacattgctctcataaacttttgattgattgagacacggtctcactccgatacccaggctggagtgcagtgatgagatctcagttcactgcaccctcgacctctggggctcaggtgattctcccacctcagcctcctgagtagttgggactacaggtgcacgccaccgcgcctggcttttttttttttttttttttttttttttggtagagacggagtttcaccgtgttgctcaggctggtctcagacttcaggtctcaagtgatccacccaccttggcctcccaaagtgctgggattacaggtgtgagccactgtgcgtggccttcttataaatattttaaatgaaatgatatttacacatcctgttttgtacttttttccatttttattatgagatggtttatgtataaatttataacatataatttttaaaaatctgactcctcagctttgttggtcctagactttgtgtcctgaatagctattaaaactgaagtgcaggccgggtgcggtggctcatacctgtaatcctagtactttggggggctgaggcaggcagattgcctgagctcaggagctcgagaccagcctgggcaatgtggtgaaaccctgtctctactaaaaatactaaaaaattagctaggcatggcggcacagcctgtagtcccagctactcgggaggctgaggcagaaaaatcgcttgaacccgggaggcggaggttgcagtgagccgagatcatgccactgcactccagcttgggtgatggagtgagactgtctcacacacacacaaaaaaaggccgtgcacggtggctcacacctgtaatcctagcactttggaaggctgaggcgggccgattgcctgagctcaggagttccagaccagcttgggcaacatggtgaaacctcgtctctactaaaaatacaaaaaaattagccaggcatggtggcacatgcctgtagtcccaactacttgggaggctgaggcaggagaactgcttgaacccaggaggcagaggttgcagtgagccgagatcatgccactgcactccaacctggacgaccgagtgagactacatctccaaaaaaatcaatcagtcagtcaatctgaagtgcaaagtaagagacagcaagatgctccgtgggcagcagctgccttcagagcactgaatatctgttcttggtttgttgttggcccttgggggatttcccttagtttctgcatagctcagtctgcattcgtgttcgttttttagggctgccacaacaaattatggcaagctgagtggcttaaaacaataggagtttattctctcacggttctggagaccagaaatcctaaatcaaggggtcagtggggccatgctctctgaagaccctagggttgaatctattccatgcgtttctcttagcttcaggtggttccagcggtctttggtattccttagctactgcaacctctgcctctgtcgtcacatggtgttctctctgtgtgtgtctctgcctgtgtctcttctcttcttataaaggacaacagtcatattggattagggaccattctaatgacctcctcttaatttgattacgtctccaaagacctggttttcagataagatcatattcatgggtgctgggggttaggacttcatgtcttcttcaggtgcgcaattcaatgcataatagcatttaaaaagatggcttttggctgggcatgggggctcatgcctgtaatcccagcactttaggaggccaaggcaggtggatcacgtgaggttgggagtttgagaccatcctggccaacatggtgaaactccatctctactaaaaatacaaagaattagccaggtgtggtgatgggcacctgtaatcccagctgcacaggaggctgaggcaggagaatcgctcgaacccagaaggcaaaggctgcagtgagccgagatcacaccattgcactccagcctggctgacagagcaagactccgtctcaaaaaataaaaaataaaaagatgcctttccacccccagtatttttagtgtttgtggtggatgtgatttccaggatatctaacctggcatattgctcgaaatggaggagcatcttgctttattcactgaacaaatcttggagatgtttccatataagtatataaaggatgtctttgttttgtgttgtttaacaaagcttagtatttcattagatgaatgtattaaaattgctgagtagtcccaacttgttggccattttggtttcttctgatattttgctgttacaaacagtgccacaataaagagcctttttatggatgtgccagtatacctgtagaattgctgggtcggaggatatatgtaattgtaattttggtagattttgccaaattgttctccatagaggttatgccagtttatattcccaccagcaatgagagtactggctttttcccacatccttgtcaacagttttatcagcgtttagactttgggtctttctaatttgtagatttttaggtcttttgatttgtaggaattgggtatgtacattagcgaagttagccccttgggatattcattgtaaatattttttccgcgtttttcatttgtgttttgacttgacttttggtaggtttagctatgcaaaattttcttttaaatagtgaaatgtatcaatattggtttttaagttttcctgattttgtatcattgttagattcttctcactcccagattttgaaataatcctcccaaagttttttttctaataccatttggattcctttttttaattatttaaaattttaaatatatttttatttatttattttgagacagggtctcactttgttttggtgtcaaatatgaggaggtatggatccaactttttcagatgctcatttatcatataatcaatcttctctgtatggggagatatatactgtgaaagtatgtagttatatagatggaatccagatggcagctgatgtatttttttcagtcttacggtgatcttttcattttaatgtttctagtgttgatttgagtaacttcaattacctcactctttttttagttagcgttttactataaatattggggcaacagtgttcttttgctaatagtctcaacatttggcttctgatctaataggctgtaggaaacattatttatgtcaaaaagaaatccatttgaatttttaaaggagtaaatatttatgtggctaaaaaagcaccaatggatataatttaaaaatctttcacacagtttgactagtttgtttaggcaaagagttggaaacaggactgggaagtctagattggcacagttaagaagggccttgaatgctaggtgttggtcctcagttgtgggtggtagggggatagcatgtgtcactaaatgtcactgaacatttgtgagcttgactggaaccatgttgtaggacctatatctgatggtggtatgaggatggactggaagaggcagccactggaaagagctgttaggggagcacaggagaagtaataaagccctgcacatggtggcctcaatgaatatagagaggagggaacagatgtcagagaccctgcagaagccgaatccataggccttaggaattaacgaagtgggagggaaggaaggggaaaatcttacataagtccacagttgacttttcagttagcaacttcatgtatgtatttgttttgaaaaagtgcagttattaactttatgttctgttaataattgggtatgaaacaaaattctaacctctcagactttcctacctagaatatgattttaaatgtttatatgcctttatcttgatttttccccctcaaaatagttccctgaccaagcaacacagctaaaatggaatgttcagttttgcctgacgatccctcccagcgcgccgccgattgcacctcctgggacgcctgctgtggtgctgaaatccaaaatgctattttttgtaagtaccacccagcatgtgtgcatgtacagagcttctgagggaaatgccacatgataatagagcaacttttggataactgcataaattatctcttgttgccaaatagaggccaggattccttaattgtcagcgtagatgtcatgacatcctggttcctttagtaataaaacagaaatttattgaaccaggtaattgtgtagcacagttgcatcttaaccataatattcagttgtttgtcacttttcttgtcatgtgtaattttcttttgcttgcttatcttaatctgaaagtacagtaaatgatagtacctttgatacatttagacagatgttttatgatgtttttattctctttgtgtgtgttgtgtgtatacagcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgttttgtgaagaataaaagctgatacaaa

SEQ ID NO: 1124 - DNA, 81918 bp, mus musculus; identical to SEQ ID NO: 1123

SEQ ID NO: 1125 - DNA, 95379 bp, mus musculus
caatccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcagtcctcttccaggggcttgtgttgcgcccttctcgcttgtttgtctcgtgtgagcctcgtaaaccgccttgatttattacccagactaaatgcttaatttgtgaatatgaaacagattaaaaggggcggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcatgtgtctttggtcaggtccccgcaatgatccacctaacaaaggcctctcctgagtaccctctccctttgaataccccacatgtatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacctgatactgcagtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcccgatctcgactcactgcaacctctgcctcctgggttcaagcgattctcctgtgtcagcctcccgagtagctgggattaccaggcacgcgccaccaggcccggctaattttttgtatttttagtagagacggggtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaatcaaggagaaatggaaatcgggaaaaaaatccatagcccacacatacctgaacagggcctatgtcaccacagagcaggagggaggtctgctgtagctccagacagtgttggctgcagaaaaatgactcaggtgcccttgtggcatcggagttattgctcatgtgccacggccccctcacgcacaggagctggagctgtataaatggccgtggggacagaaaggaacagatgtgtcaagagtccaaggactaggtgtgtgttgtaaagccaaacagatggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctcagtgtgatcacaggtgcccttcctcaagccatctggcctgggcccagcctctgctcttggtttccctaagcagaggcgaaacacgctggaaccttcaaagcacattcctaaacactaagagagagctgtggggaagtgaaaacaaagaggccaaggagcgctggagcagttcagcttccagagtctgtgggccaacagggctggctcaagttcagtcagacttactggccctgggccaaccagagctggcagcgtgccctcttcagcccactgctcaggccccgtcgccccccaaaaacctgggcacaccccagagcaagcccaagccccaggaagccctgctgccccttggcagccctctcagaccaccccctcccccttctagttgtgggttgctagttccagagccagggaatggcttccaaaatcccttcacccagagcttcccaagagtgagtgggttgccaatgggtcaagacggggatcccccagcccctcagagtgaaccaggggtgacccaattccttggctggcagcttcaggccatgttgggcaattgtggacactcggtcactgtttaactttgtgcaacagaaaaatatcacattctgtgctgagaatcactgctcacttgtcataagtgtggcatccatgctccaagagttacccacacatacgaataggaaggatattggaccacatggtccttcgtggatggtgaacacagcatagtcagtgattcaactagcattcgttcaagcctctcttgtctgtcctgcactgtgcttgtggctgttggggtggctcggggaaacccccggttaacaagacccaggcccctccttagagaacataaagtctccccaagagagataagccccatggagctgaaaacttcattgtgcttacactaaaaccaggagaaagagcaatccctggtattactcctcaggcatagttttttggtttttttgtttgtttgtttgtttgttttaaatggggtctccatctatctcttgctgaggctgtagtgcagtgaggtgatcacagctcactgcatcctcgacctcccaggctcaagtgcttctcctgcctcagcctcccgagtaggtgggactacaggcatgtgccaccacagctggatcatttttcttttttttttttttgtagagactgggtctcaccatgttgcccaggctggtctcgaactcctgggctcaagtgatcctcccgcctcggcctcccaaagtgctgggattacagccgtgagccactgcaccccgcttaggtatatatatattttttaagccaaaggtctgatggtgtgtttctgcccactttacacataaagctgggaaactaaagactccctcatactcccagcagctgacctgctgaatgggacttgggagctgggaattccgtgctttctctccaaagggtccgcccaggtgacatcaagttcatggcagatgttatgggtaacacctgcacttggcagaaaattctaaggctataaaaggatgtttggtgcctctcccacccgcatttctcagtcactcagtttgcctctctgaaggcaaccagtgctcccagtttattgcttactcttcccaagatagtctattaaggctgattttttttttttttttgagacagtctcgctctgtcacccaggctggagcgcagtggcacgatcttggctcaccgcaatctctgcctacctggttcaagcgattctcctgcctcagccttccgagtagctgggattacaggcgtgtgccacgacgctgggctaattttttgtatttttagtagagacagggtttcaccgtgttagctaggatggtctctatctcctgacctcgtgatccacccaccttggcctcccaaagtgctgggattataggcgtcagccactgcgcctggcctattaaggctgatgcttaaaaaaaaaaaaaaatatatatatatatatatatatatatatatatatatatatatgtatatatattatatatatatatatatatatgtatatatattatatatatatatatatatatgtatatatattatatatatatatatattttaaattttattttgaaaaaaatcccaaacccacagaaaacttgaaagagcagtacaatgaacacccatatatgaaggcaggttttcaaaagcattatatttattcaacacgcctacccttggaaagaattcaaaaccccttcaaaggtctgaattagtttaactttatcttaaactgttacttaggagtacttttccctcatagacatgttgcctgcttgttcatccccctcctcccagcccccagcaccttattagtgtgcctcgtgcatagtgggcatttcctaaagcttgcaggattaaatagcgaagactatgtcgtagttagtatgggggagccagactgtctgggttcaaaacctggctctacaacttgaccagctgtgtgacctgaggcagttactctcgccaccttacttcccccatctgtgaaatggagggtagtgatacaatatatttaatgatgttgggaggattagttgatggacataaagcatgtaaaatagtgcctgggccagacacggtgtctcacgcctgtaatcctagcactttgggaggccaaggcgagcagatcacctgaggtaaggagttcaacagcagcctgaccaacatggcgaaaccccgtctctactaaaaatacaaaaattaggcaggcgtggtggtgggtgcctgtaaccccagctactcgggaggctgaggcaggagaatcgcttgaacccgggaggcggaggttgcaatgagccgagatcgtgccactacactcctgcctgggtgacagagcaagattccgtctcaaaataaataaataaataaataataaaatagtgcctggcatctagaaagtgcttaataggtgttagggacacttgagacttaaacacacttggtattaactttgctttggtgattgcatgtaagtcatttggccgagttgatggcctccgagttttccttggtaaccatgagagagacccaagaaaaccgggaatgtggcttcgtagtcgtccctcgcctgagaggattgcctacgctcagcacataagtagcaggggcttcttgtgaccagtttccactcatggagagtttctagctgtgcttattaaaaagatatttgaggccgggagtggtgactcacgcctgtaatcccagcactttgggaggccaaggcgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccatctttgaagaaagagctagcatttgttttacccacagaccggtaagatcttctctctcagggtgaagcctaggctcacaaaagcctgagatcagaaagtcaagggttagagagagcaagtaggtgcaaccccagaaacctccactgtctggcaagccagagagtcttggggccccccaacagacaaagttgtctggaattttcttcacataggaagtgtagaatggtagatgtcttaagagccagaggcaagagaggactggggaaagataaaggaatttgtttattttattttatattttattttattttattttattttattttatttttgagatggagtctcactctattatctaggctgcagtgcaatagctccatatcggctcactgcaacctccgcctcctgggttcaagtgattctccagcctcagcctcccaagtagctgggattacaggtgtgtgccaccacacgtgacaatttttgtatttttttagtagagacggggtttcaccatgttggccaggctggtctcgaactcccaacctcaggtgatctacctgccttggcctcccaaagtgctgggattacaggcgtgagtcaccgtgcccggccaggaatttgtttaaaggtatactctgtgctataaaatactgcacctaatgttaggctttgacggctataatatctgactttgacattgaggtgtatctgccatataatttaattaacgtgtgatgccggcacaatgccagagagtcaaacattctgacagctcttggaagccacataagtccctttgaagttccccccagtgaagtgacacacagagaaacctcctatggttgaggacagcccctgatacggtatccagaaatttagctgcgtcttggttatattggatggcactggcaaagccacctgctggtttgccacagttctggaggtctgctgtggtttctaagggccccaaccatggagactggctctttggggaagaagaactcattcttcatcagggacaaaattgggaggtctcctgtttgcatattttgttctacaaaatgtttttttcttcctcaactttgcttagtgcaaagtcattgagctgcacacaggaacgtaaattaggtaagaggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttttctcaaaaaaaaaaaaagaaaagaaggaaaagaaaaaagccatgatggaatggagacctttcttcctacaggggtttcccttgcaggaaaggtacaggtgggaaagctcagaggagaccccagaccgagcaagtttccttgcttacctctaagcatgtcttggagatgtggcataggatccaggaggtgtgactaaaagctagacttttagccagtctcgcaggctgtgcaggacacaccttcatctgttgtatgaaggtatatgagctggccaaagattcgcgttcttccttgcagctccttttccccccagttctgcccacctttctcttgctgtccttgaataatgtgggggggattcctaagtgtctctgcagaaagtgatgatttctaattttgggcctcctttcaatgaattcctccagggctctgcagtcagccaagtactggaacctagcccttccctttaggaaggaaagctcttggttcaattgattccgatggttaatggaatctcatcaccgttgcccagagtggttctaatcaaaggaatccactgtctaaaaattcaaggtagcagcatcaaggtttacatcttgtaagcaaagagactggggcactggggcagatatgttttatggtggagccccatggggattcagtctcttatttgggagaattctggctcctggctccaaaggtgtgtgagttgatccatcttctgtaactaatcctagcctggacttggaagggggactgccttttttattttttggtgtttggtttttgagacagggtctcattctgtcacccaggctggaatgcagtggtgtgatcatggctcactgcagcctcaacctcctgggctcaagtgatcctcccacctcagcctcccaagaagctgggaccacaggtgtgcgccactacacccagccaattttttatttttagtagagacaaggtctcattatgttgctcaggctggtcttgaactcctgggctcaagccatcctcccgcctcagcctcccaaagtactgggattacaagtgtgagccaccacgcctgaccatgtccttgatctgtaaatgacagtagcttttggaaactgagaaaataaaaatctggatcagacttcaagtcccctgacccctctctgatctggtcctcgtcttcccctctcctctggttccacagctgccacagagcacacccctggggcagcccagtgagtccctctacccattcatgccctcctgcttgttctgccctgggagggagcctcagcccctgagccccctgcctggagtgatccccctgctcaccctgactcccagctccaggccccacctcctctgcggagcccctcccaaatttctagggggttacatttcagtctaattctcccagatgcctttgtgcttattgtcacagccacaaaacttatcatttggttgctctgaaatgactttacgccttatctcctcgcttcagttgtaagttcttagagcacagggaccacagagcctagcaaggtgttaatacacatgagtgtacttactggttggatagcctcccatcaatttctgtctcttagtggtgtgggagtagaaaagactccccagatgttagggccaagaaggttgaaattgaggccgggcgcggtggctcacgcctgtaatcccagcactttgggaggccgaggcgggcagagcacgaggtcaggagattgagaccatcctggctagtacagtgaaaccccgtctctactaaaaatacaaaaaaattagccgggcgtggtggccgtcgcctgtagtcccagctatgcggcaggctgaggcaagagaatggcatgaacccgggaggcggagcttgcagtgagccgaggtagcgccactgcactccagcctgggcgacagagcgagactccgtctccaaaaagaaaaaaaaaaaaaaaaagttgaaattgaagtagatggccgggggcggtggctcacgcctgtaatcccagcacttcgggaggccgaggagggtggatcacgaggtcaggagttcgagaccagcctgaccaacatggtgaaaccctgtctctactaaaaatacaaaaatgagccaggtgtggtggcatgtgcctgtaatcccagccactcaggaggctgaggcagcagaatcacttgaacccaggtggcggaggttgcagtgagctgagatcatgccactgcactccagtctgggcgacagagcgagactccatctcaaaaaaaaaaaaaaaagaaaaaaagaaaaaaaagaaattgaagcagatgagctcagatcatgagggattttctgaaactgctatattttgaagaaaaccttgctggtcccctccagttttctgtaataacctggctgagcagtgggtttcactgtccggttcacgcactaactgcttcagggtcacctggggtgccagttcagaattcagagtcctggccccacgcctgaaaatactgactcactaggcctggggtggggcctggaaatctctatctttaacacgccactgctgactctgacgcacagccaggtttggaaactagtcgagtctgaaaagaatgttctcttcttggaagtgagaaaatgttaggggggcaccgtgagaaggggctatgatttggattctgagagaccaggtttgagtctcagttctgccacttaccaggtgtgtgaccatgggcaagttattcagcccctctgcacctcagtttcaagtgggaacaccacggatctgttttgtgactagtgccatgcaacaaattaccccagaactttgccacttaaaacaactctttggccgggtttggtggctcatgcctgtaatcccagcactttgggaggccgaagcgggtaggtcaattgagcctaggagttggagaccagcctgggcaacatggggagaccctgtctctacaaaaatacaaaaattagggtgagaggattccttgagctctggaggtcgaggctgtggtgagctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgtttttctcagtttctagtcatttctagtccttttggatagtaaatgcagggtgcagtgagcaccttctcattctgaccagctcagctctctcaggaggttgggactgcaagatctgtggttcactgtcacccccatatcagccttacccatgtgcctgatctcaagtgcaagctcactgggctccgaatgggaacacctggctgagtactgagtgttttcaggtcagacaacctggtttggggcccaggagggtcatctgttgcaatggtggcctgaggggcagctggagagaaagagagcagctttggttggcgtgggtcttctgtctcacggtcatgagtgggccccttctctgaccttgctttcttcacctcaggtctggagacagtggaggagctgaggaaaggtcacatggagaccactggggccagcaagccagctccccagggaaggtggggggtggcttgcatgacagatgcctcaggatgaggggcattaagagggtggctgggttccaggggctgccagagtgggtaggatttgccaaatagggtacccttggaaggcaggacacaagagggaggagccattatgtgcctgctgcaattcactggcatttgtggagggggtcgtttgcccctctggcccacacccttattcctgaaaaaggcagttgggcctgtgtttagcactccgaggaacctgctctctctggtcctcttcttttccttctggggctcctgaacctccccaccgacatgcttccctcattaccaccaagcctcacatgcagcagctgccttgctgagagcagacaggggtaggcttggagctgcacagcgatgcgacacatgatggggctccttctatgtgccccacacctagccaagggctaaaaatggtcacacgtctccatgatctcattgacgaactcacaccatgggcctgaaggagtgatgtgtgagtcagcaccccggaatccctggcagagcgggtcttggaggaccaggaagaccaggggaaacctcccagattgagtcattaggataggtcatagtgcaggctgccctcccctcagtctccatgcctcagtttcctcacctgtaaaaggagagtaactaagtgcccacctcatagtgtgaccacaaggagggaattggggtgcacccttaatcaggctgctctccacctgttgaagatttagatgaagagggacagggaaggagggcaggtgcatagggagttgctggggcaggggaggcagagtcatggaggagaaggcccggagggtggtagaggaggtgcctgctgcacgggtgaagtctgttcttcttcttttttttctttttggatggagtctcgctctgttgcccaggctggagtgcagtggcatgatcttggctcactggttcatacaattctcgtgcctcagcctcccaagtagctaggactacaggtgtgcgccaccacgcccagctaatttttgtatttttggtagagacggggtttcgtcatgttgtccaggctggtctcgaactccggacctcaagctatccgcttgcctcagcctcccacgcctgctgggtttacaggcgtgagccaccgcacccggcaaggagtctgttcttagaggcagagccaccactcctgctcccaaggaaaggacagtgaaacagctttcgcccataccccaacccccacctccctaaggccccgcagctcctccctccctccgtctggactgtttccccttctccctaagacatttcctggaagctctgcccacagttcttccttctacttatatacctggcctggccccagccctgccactgaggcctggcccccccattatgtgaccagcttttcctcttcttctttttttttttttgagacggagtctcactgtcgccaggctggagtgcagtgacatgatcttggctcactgcaacctctgcctcctgagttcaagtgatcctcctgcctcagcctcccgagtagctgggactacaggcacgtgccaacatacccagctaatttttgtatttttagtagagacggggtttcaccattttggccaggatggtctcgatctcttgacctcgtgatctgcccgcctcagcctcccaaagtgctaggattataggcgtgagccaccatgcccggctaacttttcctgtttctactcacttgggctgagatccccgttctcctatgtcaccttccttaaacatcacaccttggctaagaggaaagactgtccatttgggagtctatgcccactagctctgcgacctcaggagagccgcttaacctctctgagtctcagcttcatcatgtgcaaaatagggtcatttagttgtgactagtgcctcattttgaccgtacttccatgaggattgaataagggaatgcattgaatatgcaacaagtacatagtaggtacttaataaatggcagctatttccatggtgattctaggcctgtgtatccagagagtatttgactaatagacatctgcacgcctgtaatcccagctactccagaggctgaggcgggaggattgcttgaggctgggagtttgacaccagcctgggcaacatagttttttacaaaaagccatctgagggtatgacttgcatagggagccacttattattggagggcagataaagaaaaggaggtattcctttctttcccctgatgattcaggcaaggtggtccctgctcccttttatttcctgagttacatctatgctgtgccctagaattggaatcagtaagcacagatgccattggagtttttccccaatattcttttttttggagacagggtctcactctgttgcccaggctagagtgcggtggcgtgatctgggctcactgcaacctctgctttccgggttcaagcgattctccagcctcagcgtcccaagtcgctgggatcacaggtgtgtgccaccaagccgagctaatttttgtattttttgtagagacggggttttgccatgttggccaggctggtctcaaactcctgagctcaaatgatctgcccgcctcggcctcccaaagtgctgggattacagctgtgagccgctgcacctggcttctaacccaatatacttttttgtttttttgtttgttttttagaaggagtctcactctgttgcccaggctggagttcggtggtgtgatctcagctcactacaacttcctccttccgggttcaagagattctcctgcctcaggcacccaagtagctgggactacaggtgcatgccaccactcccggctaatatttgtatttttagtagagatggggtttcaccatattggccaggctggtcttgaactcctgatctcgtgatctgtccgcctcggcctcccaaagtgctgggattacaggcgtgagccacagcgctcggcctcttccccagtattcttgctgccttttttttttaaatttatttatttatttatttatttatttatttatttatttatttattttgagacaaggttttgctctggagcgcagtggcatgatcatagctcactgcagcatcaaattcctgggcttaagtgatcctcccacctcagcctcctcagtagctgggactgcaggtgagagccaccactcctggccagattttaattttttttttttaagacagggtctcactatgttgcccaggctggtgtcgaactcctgggctcaagtgattatcctgcctcagcctcccaaagttctaggatcacaggtgtgagccactgcctagtcaacagacttgcttctaagacttttggatggaaactcttctagagtatatttcaatgagatatatcagtttgctattgctatgtaacaaaacactctaaaccatagtagcttaaagcaacaatttcttcttctatcacaattgggtaagttggctgggctgttcctctgctggttacatctgggtttactcatgcagctgcagtcagctagccaacagctgtggggagatccaagatggcctcatgaacagtgtggcagttggtgccagctgtcagctgcagtgaactgtcactcttctccctgtggcctcacatcctcaagtatgtgagactggcttccttacgtggcagcctcagaactgcctgagagggtgaagcaggaagctacaaagtctcttaaggcttctcctcagaagtcacacagtgtcacttctggtgcattctattggtcagagcaagtcatgatgccaactcagatcctcgaggaagagatggagattccaccctagattagtctgctggggctgccataacaaagtaacatacactgggtgactcaaacaactgaaatatattgtcttactgttctggaggctgcaagtccaagaacaagttgtcagcagggttggttccttctgagatctctctccttggcttgaagatggccaccttctttgttgtgtcttcacatgttcttcccaatgtgtgtgtgtgtgtgtgtcctaacctcctcttttttttttttttctttttctttgagacaggctggagtgcagtggtgccatctcagctcgctgcaacctccacctctcaggctcaagcaatcctcccatctcagcctcctgggtagctgggaccacaggcgcacgccaccatacccggctaatttttgtattttcagtagagacagggtttcgccatgttgaccaggctggtctcaaactcttgggctcaagccatctgcccaccttggcctcccaaagtgcgagccactgtgcccagccagatgattcttttttgttgttgttttcgtggttttttttcttttcttttctttttttttttttttgacggaattttgccttgttgcccgagctggagtgcaatggcacgatctcggctcactgcaacctctgcctcccaggttcaaacgattctcctgccttaggcacccaagtagctgggattacaggcatgcaccaccatacccagctaattttttgtatttttagtagaagtggggtttcactctgttagccaggctggtctcgatctcccgacctcaggtgatccgcccaccttggcctcccaaactgctgggattacaggtgtgagccaccacccagccccagatgattcttttttttttttttttttgagacggagtctcgctctgtcgccaggctggagtgcagtggcacgatcttggctcactgcaacctccgcctcccaggttcaagcgattctcctgcctcagcctcccgagtagctgggactacaggcacgcaccaccacgcccagctaatttttgtatttttttttttagtagagacggggtttcaccatgttggccaggatggtctcaatctctcgacctcgtgatccgcccgcctcggcctcccaaagtgctgggattacaggcgtgagccaccgcgcctggccgactcccagatgattctttagtgacttcttctgtctgcctggaggctgtgagacatgtgccctctaggcttgccattaacttctgtgaacacactcagctgtgacagctctgagggaactcacccacccccatattagttatctaatgctgcataacaagttgcccaaaaatgtagtggcataaaccaacaataacaatgtattctatctcttgatttctgtgggtcaggaattcagataaagtacagcagggatggattgtctctgctcacaatgtttggggcttcaggtggaggagttgaagctgggatgctggatgatacatttccatggtggctcactcacttggttgggcgtgagggaggaaaaatgtagtgattagaagagactgaagaggtccagatgtggtggctcatgcctgtaatcacagcactttgggaggtcgaggcagatggatcacttgaggtcaagagttcaagaccagcctggccaacatggtgaaaccccgtctctagtaaaaatacaaaaattagccaggcgtggtggtgtgcacctgtagtcccagctactagggaggctgaggcgggagaatcacttgaatccaggagacaaaggttgacttgagctgagatctcgccactgcactccagcctgggtgacagagtgagactccacagtcaatttctcccataatcaaccaccttctccaggcagctgctggagctgctgccccaatgcatcacttcctggcacatagcaggctgcagggaccacctcatctgcctttgccacctctcttcccacttgttcagctgcccttgagcagactggatggccttccagaacaggacaaagcaggctggccacgtgtgcttttatgccctcctccccaacccgcccccccgacgccacacacacccctccatcctctgtctgacccaacactccccacaagatgcctagaatgtctttcccagggcggcctcccttaagggtatgtcttacttattttcatagctctgtacatatatgtaaggggtgtttcagaagggtttgtgggccagtcacagtggccctgtaatcctagcactttgggaggctgaagcaggtggatcacttgaacccaggaatttgagaaaatacaaaaaataccaaaaaattagccaggtggtggtggtgtgtgcctgtagtcccagcgactcgggagactgaggtgggaggattggttgagcccgggaggtcaagtctgcagtgggccatgatctcgccactgaattccagcctgggtgacagagtgagacccccctctcaaaaagaagtgtttgtggaatagaattgattttaaaacctttttaaaaaattgtaagggctaggtgccgtggctcacgtgtgtaatcccagcactttgggaagccgatgtgggcggatcactcgagcccaggagtttcagacaacatgacaaaatcccgtctctacaaaaaataagaaaattagccaggcatggtgatgcatgcctgtagtctcagctacttgggaggctgaggcgggaggattgcttgagcccaggaggtgaaggttgtagtgagccaagatcgtgccactgcactccagcctgggtgacagagtgagatgctgtctcaaagaaaaaaaaaaatgtatatagagatggggtcttgctatgtttcccaggctggttgtgaactcttgacctcaagcgatcctcctgcttcagcctcccaaagcactgggattataggcatgagccaccctgcctgaccaatagttcaaaatctttatggtccgcttaagtccgtagttcaccatattcccctgagttctctcaattcccaaagttgcaaagaggccagtggggattctgaaggtttctcctatcagcttctctggtgctcattctcccgctcccaagggccctggccttttcccaggattcattacatggtggccctttctcaccatgtggcatccttaaaagcatggggtttgaacattcagcctgagttttgcttgctatggattggtggaatggtagtgctgggagagaggaaacatttctgcttcctctgaaccctcttatgcgtgcgcgcgtgcacacacacacacacacacacacacaaccaggaaaccttctcttcccctagcccacgtctcctcccagtctgtgctcttgcacttccagagccagataaatggaggaaaaacacagctgcagatgtagccaccccaagagaaatcagaaagtgtggaagaaaaaaagaaggccgggcgcggtggctcacacctgtaatcccagcactttgggaggccgaggcgggcggatcacaaggtcaggagttccatatcagcctggacaatatggtgaaaccccgtctctactaaaaatacaaaaaacttagccgggcatggtgatgcatgcctgtaatcccagctactcgggaggctgaggcaggagaatcgcttgaacccgggaggcggaggttgcagtgagccgaggccgcaccattgcactccagtctgggtgacaagagtgaaactgtctcaaaaaaaaaaagtgtgcttaagtgactgctgtacccctactgactatacaccaccctcccctccatattgctctgttggagggtccctaagaccccttctcaatccttgttctcactccctgccactgcacacagagcttgatggcaagccgaatatggtatctccttgaaagtgagagaaacagttgcatttagaaggggaattcacctagcaggttaaggaaatggcccaaatggagatctctaatccccatgcctgtttttaagttgccatttgacccacagtggacatctctacaggaaggccagtaagtgcccgagactcccaggcctccgagctgccccagggcccaggaacgaggtcagatgtgataacggctctgatgtggccaaaagcttccatcatgctaagcagttccaaacagtcccgctcgtcaggcaggcccggggcagtggtgggtagcgacagtgtgatgctcggccttgcccccaaagcttaagcctttgatggcaaaagcacactcggctctgtactgagctgactgcctgaaaatattatagaaaacatctctcccttggcggggagagatctaagccccagtgaccggggagtttaaattttcgggatgggtgaccgaaggctgctaagaatatccagtcacaggcctgaccacaagccagttaacgccccgagtggcggcttccatggtccttggggcatgggaagaaggagccgactgggcagccagtacttgtggagtccctcagcaggaattgtgcagacacaaagtaaggagtaaaataacattaaagaaaaccaaccacctgatcgtgccctcaaggaataatctgagaagggaagacattgacctaccatggggtacttactgtgcgttaacagatcaaaacaaggacaaccatgcagaagggaacagtctccgagacaccaagtgccaacaagggaccccaggctggcttcccacagccagatggggtagttcttgtggcctggcagctggcagcctgacagaaagtcaggtaggcccagggtacacattctaccctctagccctcagtttcctcatctgcagagtgaggggtttgggagtcctgtttcgtcaacattttgggtgtctgaggccctctgggactctgatgcatgtacccctggcaaagtggacatgtgcacgagggccaccattttcacagcatttccaggggtgtccggccccaagtagaccagccccagatctcaagtgagggctctgaggtttttgtatagaggagagactgttcttggagggctggaagtggctgggaagagttcatggagaaagcaggatcgaagtttgggcagaaatgagatggctacaccttcattcaatgaatgccatgagcttcaacggtcagcaagcccaagggatggatgcgatgacaaagagaccagagaggatctggaatcgtgtgcagcaccgtttccagctggagagagagagcccattctgctccagccatgtgggctgtccttctcttcctcaggtggtccaaggttggtcctccttcagggcctgtgcacttgttgctcggctacctgaaactctctttcccccatactcatgcagctggttccttctcagctcaatttttcaaagaggcctcccaagccatcctggctaacactgccttccctcccactactctcagccacactgctctgtttcatcttctgtgtggcacatgtcatcatctaaagttaccttatttgctctgtttatggtccatctcccataggataaggaccttgtcagtcctgttctccacggtgccctggcacccaggacagtgcttggcacagagtaaacaactgccaaatttgcaatgaaccaaatgaagtaattatagccttaacgctagatggctgtgcactggggaggcctgtggcgtagaggaagggcagggtggtttgagagggtgaggctgagccactaaactggtctggatgactgtttggggaaggtatcttggaggaagtgctgtttgaacagagttgtgaatgactaagtgaagcgggtggagggatcgcaaatctaagccagctcccggtggcaacggctggatgtgggaaggggctggaaacagaagcccagagccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctgggccatgcctagggctgccatgatgaagtgctgccaagcctccaatacggcacatctgcctggcgcatcactctcaccccgctcctccccccgccccaactgtggagcagtaagtttgcttctattcacgtgattttattaacaaaatttgcttccttgctgtctctagaagcagcacactgccctcccccaaccccccaacttggctcagagcaaccccacactcctgctatcaggtcatctgcccagagtgtgattgcagttttaaaactgattcctccctggtttattatttttttttagtttctattttttattttctggaagtacagcacacagacagaaaagtgtacaaatcctgagagtacagcttgatgaattttaacacacccatgtaaccagcttccagatcaacctgcagtgttcccagcccccaaggagtcccactgtgctccccatctccaaggataactccatcttgactcctcttcttttttttaatgagacagagtctcactctgtcacccaggctggagtgcagtgctgtgatcacagctcactgcggcctcagcctcctgagtagctgagactacagcacgcccaccacacccagcttatttttgtagtttgtgtagagatggggtttcaccatgttgcccaggcagggcttgaactcctgggctcaagcgatccacccacctctgcctcctaaagtgctgggattacaggagcaagccactgcacctggcccatcctgacttataacaactcagattaaaacctttgcccactttaaaacttgacataggcaaagcgccactgcactttagcctaggtgacagagtgagaccctgtccaccccccaccggcaccaccaccaaaaaaaaaaaaaaaaacaacacccaaactagatgtaaatggaatcctattgtgcatattcttttgaggctggcttcttttcatttgcaaggtgttgtgtgtgcttgcatcttaaaaaacagagtctcaggccaagggtgatggctcatgcctgtaatcccagcacttcgggaggccaaggtgggcagatcacctgagctgaggagtttgagaccagcctggccaacatggcaaaaccctgtctctactaaaaatacaaaaattagctgggcgtggtggcgcatgcctgtaatcccagctactcgggaggctgaggcaggagaatggcttcaacccaggaggcagagattgcagtgagccaagatcgcactactgcactctagcctgggcaacagagcgagcctccgtctcaacaacaacaaaaacagagtctcccaagcagcctcccacctgaggcaagggatcagggcccagtctcaggaggcccctgtagcctgtggaatactcagtagaggaactagggggtcagtggagactttgtgtggggcagaggacagcattggtgttttaagcaaatgacatgctaagcattgtgttagatgctgcctggatacaaaagtggaagatgcggttaagagggggtgaagggaagataagactggatctagagtcggccaggttgtaagaatgtcttgggctgggcacagtggctcacacctataattccagcactttgggaggccgagacgggtggatcacctgaggtcaggagttcgagaccagcctggataacatggcaaaaccccatctctactaaaaatacaaaaaaaaattagccaggtgcggcggtgggcgcctgtaatcccagctactcaggaggctgaggcaggagagtcacttgaacctgggaggcggaggttgcagtgagctgagatcgcgccactgcacaacagcctgggggataagagcaaaactctgtctcagaaaaaaataaataaaataaataaaagaatgtcttgaactgcaagaagaggaaagaaagtgaaagctcacacctgaggggaggacagaaaggtcagaagggttgtgactccccgcctcccaaaaagatcccctcagtgctacccttaaagtcactttcctgaaagggggggtccttgccttgggggaggagacaatttcagttctattatctcagtcatccagaaagacttctctgtgcctgtggtgtgttagagagaagacagatagggagggaggaaaaggggtggggggggtggagagagagagagagagagagaaagagtgcgagcatagtatacttcctgggaaactatctctcgaatagtagttctaggaagcctcatgccagagggcagtagtactggcctctgccttcttgatggtgcccttggacgtcagaaagaggaggaagcctcagggattggcagagacatttgagagtttcagaagctgaagtccagagagggtgagcgacttgcccaaggtcacacaccaagaaagcaagcattagaaaggggatcgagtgtcccctccatggtttttccatgatcgtgtaccaccctttcactttacaaagagcctagtgttgccaccaaaatagctgaattacctcatttttgaaaggcgttatgaattcacttctattatgtggaatggggcagagatgttgtgagcaggcatgacattataattcatattccacttcttctatttatctttgctgggttttgtgtatctttggaagcagccttaaatcattattggaacaaagtagggagaaaaataataatatgtaattacaaatgaggaatagaccgtatgatcctattaattgccttccctgcaatctttatttttggtattttcagaataattaacggcttaggtctcgattggtggaggtggtgggttagcactgaactctaaacagtaacatcacctactccaggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcactgggattacaggcgtgagccaccgcgcccagccatataggacagttttctatatgacatgagattattaatgtgtataaaatgtttagaactgtgcctggcagatagaaagcccttaataaattctagctattgttcttctaggagctgaagaacattagtgactctcttttcctcaaatcccaagagctcttctgcttcagaagagctgtgtgatgagttcttcccatgttatcccttcgtgaactaccttttcccatggtaaggacaagagtagtctttatggaagctcaaaacggggaaaagtgttgcccaggaatatgaaagggcaaggtagcttataatctcgccagacattgagccataatttagtattggtggaggtacaggtatttttcaaacagaatctatttgttctggggaggaagtccttcccttgaacatcttggccccacacttttttttttttttttgagacacagtcacactctgtcacccaggctggagtgcagtggtgcgatctcggctcactagagtttccgcctcctgggttcaagcgattcttgtgcttcagcctcctgaatagctgggatcacaggcgtgcaccaccacacccagctaatttttttatttttagtagaggcgaggtttacgccatgttggctaggctggtcttgaactcctgacctcaagcgatccgcctacttccacctcccaaagtgctgggattacaggcgtgagccaccgagcccaggccggccccacactttttcaaggcttacctggaaggaaggcaactcttcattcagatgatcaattcttaggttcccatggtgaacacaacagatgagctgaggcctgctgatcccagaaagaaagaaactccttttatgatacttactgcagttggcgagttgccaggatgggcccagaaggatgcaattgcagaagctatgtaggatctggtcccagaaatagttaaaggtttggggaaacagtgcatatgcatgacagacaaacaatataccctatgggaaagagcctaggtttggagtcaggtagaatccccgtagccacactctcctagattagccatgtgttttggcgcagtggctcacgcctgtaatcccagcactttgggaggccgaggtgggcagatcacaaggtcaagagattgagaccatcctggctaacacaatgaaaccccgtctctactaaaaatacaaaaaattagtcgggcgtggtggcaggtgactgtagtcccagctacatgagaggctgaggcaggagaatggcatgaacccgggaggtggagcgtgcagtgagccgagatctcaccactgcactccagcctgggcgacacagtgagactccaactcaaaaaaaaaaaaaaaaaaaaagtgaatggtaatacctaagccatagggttattttggggtgtgagtgagataacttggaaaagtacctgataaagtaactgaaatgaacaaaggtccttaataaacagtagctatttttatcacataggaattattcattgttaaaagacttgctttgctatcaaaaacagcgcagggacacagttactgttagaggtcaaatggcatggaattcagagaactccaattgcccagggtcagctgtgagaagaacctacacttctggtttcttagggtctcaaggagaaagacagtctcaatcttctgccactaagttaaggaccaaatgattggcaataggcaaagtactctaagaaggctctggtttgggttttgtcttccttttggctttctcatctcctggggatgatattctgcaggacttagttaaggacaggactcccaaggcctccccaccagcatgcacaccaggtcacttggctcctccagccgacagagacctgtacacaggtgtcccatactcccacgggcctccccaaaagacagtgtctcccccagccttatgcttcactttcctaatttcttctgccccaatcctcaccagaactacagagccactccccaccagtccaggtaccccctttcctatagcaccctctccacaactgtcttgttctcttgaacctggtttcttctctagccaggatatagaataccgattcagttagcaaaaatgtattaagtggctggctacagtggctcacgcactttgggaggctgaggtgggcagatcacctgaggtcaggagttcgagaccagcctggccaacatggtgaaaccctgtctctactaaaaacacaaaaagtagccaggcttggtggcacacacctgtaatcccagctactcaggagaccaaggcagcagaatcacttgaacccgggtggcagagattgcagtgagctgagatcgtgctgctgcattccagcctgggtaacagagtgagactctatctcaaaaaaaaaagaaagaaagaaagaaaaaaaaagtattaggcatgcaatacttcatttattgtttatcagatttttttttcatcaatatgtggtgagcaccatgctaggcactgggcacatacagccagaaacaaaattctgagaacattatggatatatgtacatcgctgcacactgatgcaagcttagcacctggtgatgatacactgtaccattatggacgatacggtcttgctgagggaggtgacctcccagggaccaacccgcagagcctattcaggagctgatagcaggcctgtgtggttggccttcagagggtgagctaaacactggcaagcaatgaagtggccttgttaaggcatttagattttgttctaagtgcagtgggaactagtggggtagtgacattcaacactttttttttttttttgagacatggtctccctctgtcacccaggctggagtgcaatggtgcaatcatggctcactgcagtctggaccttccagggttaagcaatcctcccacctcagcctcctgagtagctgggactacaggcgtgcaccaccacacttgactactctttttttttaagtggagatgaggtcttgatcctgtctcaaaataaataaataaataaataaataaataaataaataagatctttctagctgccacgttgcgggtggactggaggatagcaaaagtggcagcacagagattgctagaataatcatcctgtataataatccaggcccaagatggtggcctggcctcaggtggatgtaggaaaatgggaagaagtaggcttactagatagactatttggaagtagaatgggttagctttgccagtggactggaggaaggtgagggggagatgaatgaaaatgggtcaaaaatggccccctaggattctgctttaagcacctgagtgggtgagccattttctgtgatggggaagggagttaaagcaaagagcaggttctaaaggaaaagctcttctctatctaagagacatttgtcctgctcaccactgtttccctagcacccgctacaaggcctggcatttattaaatgcccccaaatatttgtaaattaattcctctttttagaattcagttgtggctgggcgcggtgctacacttgtaatcccagcactttaggaggcagaggcgggtggattacttgaggtcaggagttcgagacacatgccaacgaggcagtgtggcaaagtgattaggaccatggactctgaagataggactgcctggatttgaatcctagcaccaccattttctaggaatgttcagtaacttctctgatagtttcctcatctggaaaaaatgtacataataactctgcctaccttatagggcagttgtaaggattaatagttaatttatagaaagcactttgaagagagcttcaacctaacaggcgtgatgtaaatgcttgctattgttattaagctgagcgtagatgcaaagttgagataccaagtttgaagtttgatatggggatttggaactagaaaaaaaaaatgtaagtcatcaataagtaggtggtatttaaagccataaacctggatgagactggtggggaggaaggggaggatccaggcccaaggcaactggtagagcatagaaaagcccacaaagaaattgaaagcggttctcagctaggatgaaaaccctgtgagcaagcagctcaagggagcagtggtcatggtgtggtaaatgcttctgggaggccaaggaaggcaaggactgaaaaacaacgccgcccccccaccccggcccccactcctggcaacaaggaagtaaccagtgatcttgagcactttctgcagaatggccagggaggatggaggggttgaggagtgagataaatgaccatgtgtctatacagtgaaattccaccagcctggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggcggaggttgcagtgagccaagatcatgccattgcactccagcctgggcgacaagagtgagactccgtctcaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaatggttgattgtcttagaggtacaggatctacaaacttcccactgtggtccctgctggtgaagtgtgctcagagttccagaagttccctgagttcctgataagacaggaagctaggggagaggagaatattttgcctgaaatgttaagatttttttcccccatagggattcaatgacacgcatgccctggaaggtttcaaaaattggaaataaataaaaattccaagaagaatttatattcctgatggctatgctgatggtcttgtaaattgtatatttaatcaaagacactcaaatgtcttttttttaactattgaagagctatttaaatgtcaacataagtgattccctcccaaatagtgctgtttatacattacttcccctaatagaccataatgattcataaggaggcatttctcgcctctaaattgtaggcctattgaaatataaattaagatgataaataatttgaccttacctgagagtactaagtatttacatgtgtcaaatacgaaattaccctgaacatcatggtccctaaaaaggcagccttcctctcccgggtgaattcattaaatgaaacgggtttataaatttctcttagagtgtggaagagagagagaacacacaaaagaacgggcccggggacccggccgtccccgccctccagctttcccatgaggcccggggggccgcggaacccactccccggcggggagaggcgggtgcagaccgcccccgcgcgcttcccgcgctcccctctccccctccttctgcgacgccgcaggagtttcaaaacatggagtttccacaggaactttgccaggccgagctcgcagccctcccgggctcccgcagcgggattcgccgagtcggcggcgccgcgcggcctccccgccccccacgccctccggggagccgctgacccggcggcctcgggcagctccgcaaaaccgctcggtggctgtagaacctggggaggcgcgggggctccggggctccgcacccccgccgaccccgtccgggccccggagggtggcagcctggcgccctccgcggggccggcgccgagtccgtccgccggctctgttggcttggctccgccgcccggggccggggccgaggagcggaggtcgccggccatggcgagcgaggctgggtacctggccgcccgctctggagttttgttttgaagcccggcgtgggggaggggcagcacctcatcaaggagaaatttcctgttcgcaagcaagactccgcttgcagagtttctgtcctgcccttgacctgacaagtggatctcggctgcgcgggtccccgagagtcgagccagccgcgccaggagcgcgcgggggtgggggtgggggcacccgcgccgaggaccggggagcccggctgagcggggccgacgcctgccctcccggttcccgggcgcacccgggagcgcagagccgagcggtgactaatctgcggctccgggcctcttggcgcgcagcccgggttcgcctcccgccccctcgtctctcctcctccccgccgccctcccagcccagcagcgcagcgctccgccgagcgaatcgtgcgggccagggccgccgccgccgccgcgttcccgggagtgtgggaagcgggtcgaggcgggtggctcgggagccgtctccagtcggcctccttcgacccgggaccgaatgtgcatgtgttaccttccccttaagcactttgatcagcgttttctcctcgcagccgaggagccagagcgaaccggggcttttaaccccctgcgtgccggctccaccgtgggctgagggaagagggtgccgcagggagattggtcgatacagggtgcgatcagtttggtttagcaagcctgagccaggaggagcccggccggatccgaggagcttgcccaagcgcgggacgctctcctgtggagagcaggccgctgaggcccgaggcgactcgttaatgttcaagctctcccaggggcagcgctgtaacgcgacctgcctggccaggcaaggtgcgggcttgaaaggcccggcgggcggaggcttctggaggggcccgggaggccatggcgggacccgccttcacgcacccggttcgttggcgcgtgggtggctcctaaccccggtggaggctttgcgctcgcctcgcggactcggctctggccgccgctccctcccctggtccaggcctcgcttgggagttaatgattgatttactggctccgcgcggccggcgccctcccagctatttgtccaagctgaggagttgctggcgagcagcgcagtaggccaagagagcgggggtcgccggggaagggaagccacgctgccgacgggaaggagaggccactagattagctcccacttggcggctctagctgtgtcggggcaaaccctcaggaagccgggcccgggcgaagggagcattgggaagctccacatgtaaatgggttggcagctggcgattaggccgcccgattttatgagtcataatgggcctcccgcctggccctcaacctgctcgctgtggatccggcgcgcttggggcccaagtggtggaccattccggccgcgcagagggacatgcttctgggggcccaggccgccgaaggagttgagaaggactttctctcctttcttgtagaaggcaacacaaacaccctaaatcaaaccgctccgacaatcgaaggctccacacagacacatcaataaggatttcgcctcccgcgtatgaacgcacagaaacacttgtcctatttttatgcaaatgacaccacacaaatagatctcgcaggcccgggagaggggcgggaggaggaggggcgccgccaccccagccagggggctgtgagaggggaggggcgccaaacccgcaccccagggcccgcgccggctcgggcgcagcggggctggcactggtcaggaggcccgccccgcgggcagtggctccctgccagcgccgccaagtcggccgcgtccccaggctgcctgcagaggcggattagggaaggagcgaagcgagcctgtgactaatcgcggggcctcggaccggagcaccaaggccatgtgcgactgacaggaccgacactagcagaggacacggcgacgcctcgcttaattgcaggcttaaaaaattgccgcctgagcagctctggcgcggagagccacggcttgcgcgtcgagctagggagcgcgcgcgcttgggtgggggcgggggttcctgctctctcgctccaaggttggaacgtttggcgtctcctggaccgagggacctggcccttgcgtcccccactctgctgggtcgccccgccccgcgtgccgaccaagtgtggctgagcccgccaggagagtacgatccagcctccagggctaggtttctgacccgaccctttccccctaaatccgacgtttccccgctttcgccctagatcctatacgggagggggctgtgcagttgggggtgacagattccaacaaatccttaaaataaaaaccacacgcacgaaagaaacactttctcttccctccccttcttcaccgactgatacaaagccccgaatgaccaaagggaaagaggtaagtcggggctgcagggagcaaggtcatcgagtgccaaaacctcggggctcacagacacgcactctgagttcttcacccctggtcacagtctctgtggcccagaccttcctggagcactggggcctctcgggggcgaagggagaagcgtcgggaggccggcggctctgtgttggggagggggagtgggagggagcggagaacccagcgagagaagtttccaccacgctctggccggctactgccaaaatccccggacccctccccgcctgcaccgccttccgttgccaccacaagtttggtttaacgagagctcgggacaaaagcaaacgttttctatagaccccgaaaacaaaggggaaagagacgcgcggggccgcggagaagcggctgctagcgtaatggtgccaggccgaaagcagagcattaaaactgcaaaagccgcgcgggcgggaggaagtgcgaggcgggaggcgggagcgcggggagggcgggaggcgggagcgcgggcgggggaggggcgctgcgccatgtttccgtgtcacccgccgagtcgtcggcgctgggctcggccgccggctcccgcctgcctccgtaacagcagaaagcgtgcgattagcagccagacaggcggggactccgggcccgcggggccgccgcacacgccgcccgcggcccgagcccgcgccccccgcccgccgggtaatcatcctcctcgctgcagcgctgtgtgcactctcattagagtagggaggcttttctctgtgcactcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccccacggggaggggcggggaggcggggtccggagaccccgcgggaacggccgcgcgcctcccagcaccccctcctcgccgccgccgccgctgctgctgatatggcgggcacgtgaagcgcagcttggcgccccggcgccagccagggagcggcctgccccgccgactcagcttacccgcgggcccaggaacgcggaaccgagcctggccgggctccgcggagcccgcacctccgcccgcagctcgctgcggccccgcaccctctccccgcctgagcccggccttggggccgcgccaggcggctcgcccgaggggaactcgggctgactaatgggacgcgtgtgggccttacgtgaggcccggctgtcagcggatacccgcttgctcggagcttagaccgcggccaagcttttcggggaagggcgagaggaggggtttccccgctgggcggtttcagctccccagggacaatccgtccgcggcaggccccaacctttggatcttgcagcctggcttggagacggtagacttggcatgtgccggacgccacggtgccgacccggtcgggggcagggggtgggagcctcggggttgtgagctgggggtgggcagaggctaggtcagcttggtctggggcgcccgccttgaggtttgcattctggggctagccactgggccggggggaatttgcagggcgctctgaggtcgtggagtctgataccaaaaccttcctcgacaaagtcttccggaaaccccttcgcgaaattcctgtgcggaaagaaggatttctaaaactccccgagggtccggttcggctgggagctttcgggttctagggagtgtgatttcctttctctccctttataggggcctataaatatcagaagagtttcttcttatttcgcattaacaaccacttcatgttgacatagttatatgaccctcccaagtataactacctgtttagtttgaaggcactgagtgcgatggcgaaacacaaacatcgaccagtaactaagagaaggaaaacccagccgcgagcttgggttggatacaggataaatcctcatcacgcatccctggttttattcagcctaattgcactagtaatcctgccccccgcgagaaagcctgaaatcctgcagtcgaggtgcgacttttcctggggagccccgccaatggggggtgggttgtcagtggaggggaggtgggttttaaatgtcacttccaaatgaaaatctttctttcttttctttttctctttttcttttttgatccagttttcgaaaagagcatttttgcgagataagaagtgaccgatcaaaatcgctaaggggaggttgtaagcagccgctttgccccagcttagcgttatcttatctctcacacttgcatggcggaaaaaaaaattggcttatctttatccccacccccttctcgccttaattgctaaaaaacactagtgtgttaaaccgggaggaaggaggtctctggagtgtcagtggaaaaggaagattcaaaaatgtgggctcccgggggaagcaagggtggcagaatttattctttcccccaggcctttctggtacaacacagggtgtagtccagggtggaaggctgggtggctctttttttaaattattattttaagaacaaaatctgggcttggccttgggtcgtgtggcttccccaggcctcgctttctgaacttctcccctccttcatctctcaaaagctgctggtgggtctgggttgaggcctctcactctgccttcatcctccctcctctagacacatcctccttttggggagggggggatgcaaggctaggacacatagcctgctggaaatcattaaaatatatgcgagtgtctgcaaacacacacttttaaatcatggcgtttcccctccacgctggtctatttaaactccagagcgagctggatctcctccctctcagtcgtttgtctgtgtcaccgacaggccgctaatggccgggcttccaggcgctgtgcattatgcattagcctcctccctccgccgcacacagaaggttctgtcaggccgcaccacacaaaccaccctgagcccccccaccccaccccccgcactcagggccgggggctgcgcggctgctaacgcgctgggaacgcaggtatggagaggaggatgagcaccgagagcagagtggttcggaaggtggaatgggagcgggtgaaatgtgccgaagattacaccgtttggaatgcccagtccgttgtgagccccaaagctttgctcctggctgcgaccttctcgaggcaaccatcccgcgccactcacctctgtgaccgactttgttgggggcgggagggcagaggtatttagagacagatcagcaccgctttcccttctgctggtccgtacccaccttcctgctgcaggcgaggggctggcagagccttctctacccctccagttcgggagtggtaccgcgaaggggttcggggtggtgcgtcttcgcagggacccggtgggagtggaggagggaagctggatacaaaatggctggggccggaggccggcacactgggtccgaaggcgagtagttggtggttccccgccccctctcccggcggttcccactcactgcccccagccgggtaaaatatgcgcagaaggcgccttgctaaataagcagccgaggcgggacgtggcgtccgggtttatctgcaggagcacccggcccagcgcggcggcgtcgagggctcttaagcccttgccgagcgcaagaggcggccagcctcccagaagcctcctgtattatgcccatttggtcgacacccaaccaccctgcgggcccccgtagtgtagatgccagttcacccacacgtgcctgtgttcggggagctcagggcctgacccaaatcgagcccagaccagaaattccaagatggttgctaggaaccacggagaggctgcccttagggccttccttccccaaacacccaataaccctccaaaggctaggaagaagaaagaacagtcatgttcagcctggcgacccttaagtccagcagtcttctgccctgggaggcagctacctttagatgtttccagatgagtgaaatcctgggaggaggatgcgcctcctgtttgttacctcgtttgagtttcagaggggaagccagctgtgccttgtgcttggaggatggggcagcggatgttttttaaagtgccattggataagcccagagttcttgtacaaagtgaccagaagactataagtgtgggtgtgtttttaaagaaaggctacctcacattatgtaaaaatacattatctgtactcatccgagtcccacctgttccagtaccaagtgtcatcgccctgagaacagcctccgaggaggaccatcggaagcctacacatacgttataagctttatgatgtggatcctagtatacgttataaataaatcttgcacacaaggttagaaggccagggtccccccaaacacaggatgcctggcctttcccctaggccagggtggagctggaggtgtgtgggagaggccctagcgggtcttgcagagtcaacctgccttgagaagggcagccaggctcaaggcctgctcctagaagggccagctcgattgcccagttgcagggcctggttagcctgaggtcgagtggtttgttataatcaggagacacttccatgggaagggagattggtggcggaggggcagcccccgctgctccatccgcagcacctctcatttcggcacctatttctttatttctccgtgggctgcacggcctcccctcccatgcactcctttgctcactctctcctcctcctctgttttcattgaaatcctccccttgctgagtgctgggtatagcagcctgacccccgggtcagctcccgaagggcttgtgggagggcaggagaggagggggcaggagaagggccaaaccgccggcacccattgcaggccccgcggcatccccagctccctgagccccttcttaagtgaggacacaagatgggattgcccttcgacagctttctgcttgttttccccagaacaattggaactaaccgggccaataggtgtaatctcccctccccccctctgccttatagcgcctcgggaaaatcccacattttaattcccagtgagtcacgaatcccccccaccactcatgcctcttaggactcccttaataagatatttttgaaatcccacggagttgaaaaatgtatccctaggagatggaggagaaaccctttaatcctaccagcctaccgtggaggcaagatccctagaaaaggtgggggaggatgttgcaaattacgtcaaaggcgaatttactggcctgtttgtctccagcatcaaatttctcccccagtcagccctcccctcggccccttcgcatttacagcacccccaccacccctgttcattttaactctaggacttttttttttctttttcttttctttttttttttttgagacggagtttcgctcttgttgcccaggctggagtgcaacggcgcgatctcggctcaccgcaacctccgcctcccgggttcaagcgattctcctggctcagcctcccgaattctaggacttttaaagttagacaaacaggcctctttgtcagcagccccgggaggccgtaagactctgagaggctgcaggccccgagctcggttcctggattttctaaaagttctggacgtttacatgcgacttcgaactccgagaaaagcctgtgcctgggggcagagttggggagacgaggggaggggatagaaggtggctgggcgccgggccagggcctctgcggttcggcctaaccgagccggaagagcctggcacggctccacactggcccaggccagttctcccgtccagcctgcagcagcagagcggcctcctcgcctggaaccacgttcagagtttccccacaaatacccagcttcagccttcccggttatttttgacttgttttgaataaaaggagtcgcttcaaaaagaaatgttgccacaacacacaaccagaggccttttctccagctgtgtctgtaactcgcatgcgttcaatctaataacttttaatgtctggtcctaaaatgtctttataaaaaatagttttacagcataatagtccaggtgtctttctgcttgttaccggagattaaaaaaatgtgtgggttggcttgcagagatatccacccccagaaagaccaggaagaaaaaagcgtgcattccattctgcaggcgctggtcctggaagcgttcgcggcccagcctggctgggcactgctcgcgggggcacttgctcgcctgtcttttgcatcagttgttataagcagctctggagcatgaagatttaattctgccgaagtttcgggtttcaaacggtagagatgtttcacttctgctttgagaagggctgtttttataactatgtgctgagaactaaaacagaatgaataaaatcgcacctaataccagtcccacagtcagtagtgagtctaatttttaaaagggaaaatatctgctagctagagctgattttggccttgaccttgacttagtaatcaacttgagatgcttttgattatttttggcatggggacactccaggatattttaaaaactttccgtgtggatttacaagccacctccatttcagatttatgtttcatggagcctgcaccatcttgtccttaggcagaaagagacaccccacccccttcccagtataaaaagaccctagtgggcagccgaatggggtcaccattggccgcgaagtccgggcccgcagtctgggcgcggttagtccggaataccccctcccccactcctaccccttcccgccagcttcaccaactagggcttctcggctcgcccttgaggctttgcgctccggggaggccggaacctcgcttctccgcttccccctccctcccgcctgcccccgccctccccccgcgcccagagccgcgccgggtgcgctggagaagctcaatacgtgtcaattgaattgaactgctgcgggcgcaggctgtacgccgccgccaagcaccgatcagcacgacgttaccgagtggaaatttatggggcgaacggtgtaagccaaaagttgctccctgtcaaggaaaataaaacgcgggagataatctcccaacgccggggcgaggggcctgggcagcccctccaaccatcagaggtacagaccgtgaaaatgctcgagaaccgggagaaatacaggcggatctccgctcgccgaccgccccccacacgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgtccctgtgggcgctccctggggctgcaggctggggggcggggcctgcggactgtggtgggcgaggggagggacatggagagcagagctcagccccctccacatcggggctgggccggtgctccaacaggatgtttgtgttagccccactctcactgctgtctctttggtggcttgttcaatcgcggtgtggaaagaaaggcctctctgatgttcagttcgtgttcaggcaggtaggctgctacggcatcctccagtctcgctaacttatctctgatataaaatctgacacaacccagggcttggcgactaggggaattttaatgagcccttttggattctgattagcaagggggagagaagttattagctctatctggggctgcttgtactgtttcgggtggaagggtggccgtgtagggggagtaggcaggaagtagctgtgtaggtcacagagggaggggggtggggcagacctaaggtctctttctgagtgggggggtacagtagccttagggctgagggctctggagggagggactgagacttttccctcaactcactgcttctccccagcccccctgctcatcctcctcctagcatgggccatgacaatgatagcttacgttgacggagcccctaagatccaaagtaactcatttcaccctttcatcatctttgtgcagtagtaactaatattattcccgctttcagatgaggaaactgagtcccagaggcgttacatgatttgaacagataataatccagcagcctggctccaaagcccagtctccccccatccccccaaactcggctcctctccaggactggctcccattggaatcacgcttttcacagttcaaaacctacgtctgcccctgtgcgtctccccaccacacacttgtcagttgagatagtgatgtaatagcccacagtgcaaagacatttttttttatgctggcatcagctctctaggagtcgtggtgaaaataaaatgcggttcagcaggctgagtgtgaagtgtggagaagcacccgggcgacaggatccatgccaggccatgctcagctgtgggctcccggaattcagccagagcccaggctcatgcaccttaaccatgctgcagtcagcagtctgctgtgccttgagcctttcctgatggggtgacccagctgccagtctccctttgacccagagcccaccctggggcatgattgtgtgggtgggaactgggatgctggctcacacctgtgggatggtcctttgaagcactagctaggtatttttggttgtatgtgactttgtctattcataccagcttgtttcttatcgatatctctggattatctttgagggaactctctagaaggatttgaaaattagctcagttacttgcagattaaacccaagtggcagccagttggtttcccataagctgagagcagcggcgcctatgaggacagggtagatgcagcgtgccaggcagggccactcattcctacgcatgattgggaaaatggacttgtgcttccagcaaacaccagaggtaagggagggctccagggcagcaaacttgccggccatagcggggtagggctcctggcctggtctttgatcctggcttcatttctgccagtctcacctttctgagcccagagcttcaagagacccttgtgggtgctctaaggaacagtttccattctggtggttttcctatagcaggcctggactaaggaacactgatccatgctttcttaggctaccaggcctttggtgcaagaagccttgagaatgtttatggaaggacaacttttccccttcaaatgtaaatgtcattatagaactttcccaggtcatcagttttgatgctgaatgttttaattactagatgaaagctttcaactttgaatccaactttctgggatttctttagtcagaaattaaaatgttaggatgatagtccattcagatgtggcagtgtaaaccctttaaaataaaagaacagtttgcttaacaggataaggtacggtatgaatgcacagctttgggagaggtttcccaaaacccctctttatcattgtcttctgcttagctaaaaagataccacatgcaataaaaaggctgctcaagctttgttttctgttaatctggttcttgaggtttagaaacaccctctgtcttcagatctgtaatagaccacctgaaaggccagttacagttgaacctgtctgttcttaggctaagatgccaatgtggaaccgcatgtgtgtgcatttagtagtgatggttaagttttctatgaatcgaataaatcatgtttttaaaaaagttaatgaggcatttaattaattaacaatgtcgggtttatggcctttatggttacattttgcggttaatgtcattcagcttatagctgcttaacagagaattgtccaacaaaaacagtttgattttgtttgggaatgggcgggctgcccttcaaacactcccatttccagcgtggagaataaaccaagtaatgtaatgggtagacagacttgtctggcttcttcattctctctgttggtgacagcggttgccacccatttaagatcccatcaccctcccatctaggagagtgtcattagcctgcttgaccccaacagaaaaggtgcaagggatgccggtcatggctggattgcagccctctagccagggcccttgattgggcctttggaaacttcccagcagacccgttgccaaaagacctgagttatgggtctgatactttgtgttaattgaatatggggcttaacctctctgggcctcaacttccttgagtgttgaatgagactcataccacttttccttcctgagatctcacaggtcactgtgggatatgacatacacatttgggaacatcagaagtgttacggtggccaatggcaaaacgtctgacctggttgttgggttactgttgtcttgcctgccatcctccaggataacagagttgacttacccttcagcctcgacatctttcatttctatgttccctcagatcagccctagtagtgatgaaggtttccaggtgaaggccataattgtcagagcaaataaaccctgggttgataggacaccaggccggctgccgggatccgggtagattgatctgtgcacagcagtcggtggcgcttagagctgatccctgagtcacgtgacagggcctctccctggctgggtacacagctcattagcttgcagccgtccactcgagtctggctagtgagggcctgctaaaagagcagcagcttcatgcggtatcctggataccagtgctcggggcaggtggcctgggagctcagaggattgtgggctttctggcaggtgagggcctgaaggaagagacgcatctgtgggcatgccttctctcttcctccccttgatttggaagggagctgccgcagtgtcctgaagcaacagggttaccggccagggttaccagcgtgcagccttaggttcacagggggagcatctagaacattctagttagtgttcaagtgagtgatcacctttgactgatgtgtcttagaaagggcataaaagaattttcagaactcacctcacgtttatgggtggctcaaatgctgcctattttaggttatagatgagttatttaagagttgtcacaaaggagagcctgctgtgacccatcaagctccccccttgccaagtggaacatgtgttgggctaccccacatgttctggctttccccccagtcttcagaacctgacagctctctgctggccatgactgctaggaaaacagtgtaacctgttgtctggtggcagatactgttccatgtgtttgaaaactttcttaatcaaggtaataaaacatggactaaattactgctctgcttactgggagcggttcattttaatgttttaacacgccaaagaagtgagattaataacagtgattctcatgcaaactgttgatgcggaacacattctgcaaagggggaagggaaggattgtcttacttagttcttgaaatgcgtaggttgtggtatgtggtgtattagattcctgtcattaacttaagtaaatatgaaaatatattgattcagccccaagtggggcggagagtgaagcaaaaagaaggtagggttattggaagcgttgatgtcatttgttgatgagtatgataccaacagaggcactgccgcccaggctccaactccgggtctttccaaggggcgtgaggaccagcctaaactcctgggcatcctcctctctgtgaagttgagaaacgttctccagctcatttaattgttcattatgccttgattggccttgcttttatctaaacttgtgtcgtcatccactactacctattggatgaatcgattgagtgaggaggatgtccttgtacttattcatgcgttgtttgaaacattagcaaccaaatccctctgtactcactgtgccaggcactgagctaagggcttgtgtgggtctctaattacagtttcttagcagcctctggtaggcgctgttactctcctccagaggtaggaaaggaagctttggagaattaggagcataactcgcccagggccaggcagctgggcagcagacccctaaatgatgctgtccctgtcatcaggcgcttcgcacatgtgtttccccctcaccaagacatccacagcccgcccgagaggttctcaggttctcaggcctgagggtgtatgtctttgaaagctacagagaggtccaccttacaaggtcattgtgcagtgatctgatggcattcttccctcccctccccacaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggtcagtgatgtgtcttgttctcagcctggctctgctgagaccaagcttccctatctgtgcggtggtggttctcagtgtatacgggaaattccaggaggaaagacagagggtgactgtaagcacactgaccactgggttctctggaattgaatccagcagacctttctggcaaatgtagatgtaaagctcccaattttgatcagtcctataatgttcctgtgaaccaaagcttctgaaaatgttgaggcctgcatgaataattgggggtgttgccttttaagaccctggactcttcatcaccatctatgaagtcactgtatttaaaatatatttgagctgaaagtcccaggagtacacacagagtgccagctgcccctccgctggttcagcaggacctgccattgccacccacatccccagccgtggccctcaccctgtccttgaccctggtttattggtcagagacccaggtctgagtcagcctgaacatcttcctggttgtgtgagtgggatgctgccatgaggctgggcactgggggtttcctgacagtgacagaaatagccaaacggaaatgtatttggtgtttcacactttgcaaatagcattccctcagattgggcagagacccatcttctccctgccaaccccaacccccagctccatggacacaggtaggaggcctctgtatcctgctgagaacacaccccaccaggcctgtttcttctccccaccgttcccttggcttctgggccagaggttaatcactgatctgtgtgaggtcctgggatcaggctttcaggagagtctctgctaatctctttgcatctagtttcttttaaaaacagaggtggcttttttttttttttttttttaatgtgtgacagttgcttgttgtattggcttccatgatgatgggacctcttttatcccctgtaagttaccttcatatggtccatgactacttaaatttgttgaaaatgttttcattttgggcttgacttccttcttaggccttggattaagatagggtttgcagctgggcagtggctctcttgcctgtaatcccagcacttttggaggccgaggcaggaggatcacttgagcctaggagttcaagatcagcctggaaaacatagtaagaccccgtccctacaaaaagaaaaaattagccaggtgtggtggcatgcgcctatagtcccagctatgaggaggctgaggcagaaggatcacttgagcccaggagatcgaggctgcagtgagccatgatccgccccactgcactccagcctggacagtggagtgagaccctgtccacccccacccccacccccgcaaaaaaaggatagatttgggtttgagatttaggcctgaaatagtctcttcatctgccctgtaaagggttagtcatcaaaataacagtgattcattgcttgacgttgagccactcactgtagctcagtttccctatctgtgcagtggcggtgactgtgcacacctcctggatgaaatactgtgcttaggaggctcagtacccaaggtgcacatgtgcccagctttgcctgttgcttttaaaggagacaactgctttataagcaagtgtggcttgcatgagcataattctattgcgcctctcttcctaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggtatgacaaagttcaagaaatggtcttattcaaaaattagatgataactcgatacaatagatgattggaatttgactaggcagaaatcacaaaggctgaaactgtaaagcttttaggagagcagccgagtgtttgaacttttgtgtggtttgactttgttctagtgaagctaagtcatctattcaccctaatgttttaaaagatttcctaaagttattcccattttccacacatgcattcttaacttaggtatggctcataggtttacatcttgagtctgggaaaaatgactcaaaccttccatacatgaaattatttggacaggtttatggtgttaggtcatcagataacccattacttaagccctgggcattacaaagtgcctaaagcagaagcacaaggttttcatgagtgtcaggcacctgcagttaaagtccttatcaggcacttcctgccaaagaatgccactaactcactggtgacctgcccttgtttaccttaaattacactcacttgttggaagaagcagcttagttaggctatcaaagaagagatacataagtaggccggacacagttggctcacgcctgtaatcccagcactttgggaggccgaggcaggtggatcaccaaaggtcaggagttcaagaccaacctggccaacatggtaaaaccctgtgtctactaaaaatacaaaaattagctgggcatggtggtgggcgcctctagtcccagcttgggaggctgaggcaggagaatcccttgaacccgggaggtggaggggtggaggctgcagtgagccgagattgtgccactgcactccagcctgggcaacagagcaagactctgtcaaaaaaaaaaaaaaaaaagagatacataagtgtaatgctactttattttgctgagaaagaggaagacaggaaatgaccttccagcctgtcatgaatgtataggaaaaaatgccacgtggctctgccatcattttgttctcagcagtagattttatcttgtttttttatttttctctccctccagattatttaaatgacctccagggtcgcaatgatgatgacgccagtggcacttgggacttctatggcagctctgtttgtggtaagctgcattgtttgctctagttccgtaggaggtgaacaagttcaagtccatttctgtctggtatgggtgagggaaagtggatggtgggcactggaagcaggactcacttgggaaagaatcttgttatttaaactccttgttgttgttgacaactgtggacatcttgctgtagtttactgattccttcctctcttatttgccctccattagaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggtgacaggagttagaaatgcgctttgagcagatgagggtgggtgggtgagtgacctccttaactgtccacgaacctcacacaatgcagtagatattttccagaaagggtacacatcagcttccttacacccagtgtggtggggggtggggcacagcatggtataaacctgccctcatcactaacaccaaggcttaagtcactccccagagaagtgggtgactggaactttatggaagggtcagcaccttggatacttaaatccttaaacactttgagaaggtgtcctccctaggactgcctgcaacagaccactgtaggatgttttgagatgtacggactacactgataaaccaccttgtgtaaggttaggacaatcattgtacatgacacttaggatattggtgtgtcatcagatttagttaatcccctctgccccctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcctgaatggagagacagccttgtgtgtttataatgctgttagtgagggtctgaggagagaagagatcaaagaaatggggatacagacttactctcccagtgactgttgatagcagggcacttggataggcttgaccctagttgtggtcacagctgaatgagcaggactttacccccagaaaggggagaaatggggcttattcagatggtcctccctagatggacagatgagtccagagttcctactgctagaagtagttactctgcctcaccttagaaaggaatggcgatggccgggcacggtggctcacatccgtaatcccagcactttgggaggccaaggcgggcggatcacgaggtcaggagattgagaccatcctggttaacatggtgaaaccccatctctactaaaaatactaaaaagtagccgggcatggtggcgggcccctgtagtcccagctactcgggaggctgaggcgggagaatggcgtgaacctgggaggtggaacttgcagtgagctgagatcgcgccactgcactccagcctgggcgacagagcgagattccgtctccaaaaaaaaaaaaaaaaaaaaaaaaaatggtgatcagagagtaggtatggtgagaaatgaggggtgggagcagaatgaaaggacatagaggctggtccacttgggttggtagttaatattaatagttgggcgcacttttcattttactggaaactcaaagcattttcctttctgttttgtaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggaga

SEQ ID NO: 1126 - DNA, 95379 bp, mus musculus; identical to SEQ ID NO: 1125

SEQ ID NO: 1127 - DNA, 123516 bp, mus musculus
cagtctgcgcatgcgtcctaagaaccccttacactcgcggcacaggctgacagtattgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaaggatccttctacctgcaggacaaagtttaagcatcctagcttggcattcaggactttcattgttgggctccactttattgttgcaaccttattccccaaaatgctcccacatagaatcctctcttccaactaggtcaactctctgtctctcaaatacattttgtgcatttctgcctcatctttgtacaagatcatctgtatgcttgggatttccctcttttctccgtctatttaattttattgaagccccagctcttccaagaaattgtctccaactcccttagtccacaagaatctcctgtttctttgaattcccatggtacttattgtctttaccacttacttggcagtgctggttttattttctttttatgtttctgtcttgctatccctgagaagaaatagagccccttaaaaggcagggtgtaagccatatacttgttcagtcttcttattatatatcccctttattgtatttgataatatttctcataaatatgaatatcatctgatgcagttacagcctttggcttttaagccttcagttggttttctgaggcaagcttcaacacaaagcagaaccatatctgttcatggtaaacattcattcatcataagtttcattttactttttctcttcagttgaatgagcatttcttgtgggaacatttcaaaaatcagagtaaacaagatcttgtgctgctcttttttttcatttaaattagatatctttgggtgactcatttgccatttgtttttgataaaatttagccacgaaatttttaggggcagtattttttaatgtagagagaccactattcattatgtgtaaatgacggcaggtacattggaactgaagaaaaatagagtgtgtttgagattatacatacatatgtacatacatacacacacatacatacaggaacacacatacagtatattctctatttgatgaaaatgatctgtttggtgatcttgttatacttaaaatgactcagtggaatactgtttcagaaccaaaccgattagttagacaagcattccttattgcattaggaagagacaagaggaagggaaaatagctaagaagcggttaatgttaatctaggtgagaggtggtgagaatctgggtgaaacaatattgaataaggagaaattaatacatttcaaaataaatgggggaaggtttttttacattaagatgaaatagacccctggttctccaccctggctgcacattacaattgcaagggagattttttgtttgttttttcaaccctgcctggatcccaccctagaccaattaaatcagaatctcaggggccaaggaacttaaggaaaaaaaatcttcccaggtaattctaatatgcactcagggctgagaaaccctaaaattgtttattttttaagcactcaagaaatatttgttctttgagtgaataagaacattgataaaagtttagttattaaccttaaagccacttgtcaagaaagtcaaaaccaaaactaggaactaaatactcaaaaattgtttcaaattgtttgataaatttacgtgaagaaaatgatgccccctaaacatgtagcagcaaaatcttttctctgctaacaggcttcctatgagggaaaatgtattttaggcagctgtttgcagagtttatctttggtgtctttttacctctctctgcatttctagtgtctgttcttcacttgcctcctccctttgtccccatcacacttttctcctttctctttctctcttcaacctcactcctcttactttattgggatagagctcaggtaaatgattatggcagcctctctaggagattaacatttaaaagggggagtttgctaatttacttgaatctccaattggtgattggagattcatgacctttttgagtagatctcccttccagatactccttgattaaaattttcacccacataaggacataaaacagtgatcagaaagttggtaacccatttcagtaaagtagctgactcttgctgtaatgtcttctccgagatggtctgtagatagatttgacaagatgaagggaaattgcatagaactttttggtccatctggatactatgataatttgttgacttgaaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactcctactttggaaacatgattatggctaataaaaagagacatggtttttgtacttaaaggatttatacaatagtcaaatgtatacagtaatataacgattagaaaagaatttcactataatatataatagtattcaaaataatatattttaatatactgtacacataagagatctggaactgtggcataaggcttaattttagaggggattaatttagtttgagaaagcttcctgaaaagttaggttaggtatttgttgcatgacaggtataagaacagaagtggttgattgggatgttttaaaattggggttagtggaatacttttgcttaaggtttaaatttaatatttcaatttagattatttgtgatataaattctgaagcatttatttggcatgaaggtagacaagatccagaacctcactgagaacataagaagtaatgctagggacacttactacaaataaagataattgaagacttacaaaattgatttgctgggaggtgccatttgtttaagttcctaggcacacagtgaaactttgcaaaagaggcatcttgttctcccagcccagcctagcagcccactctgtgagatgccttaactgcatgatacacacctccccattctgcagaggctagtgatcatcatgacctagaaagggaaatattttagttttctttttttctctacactttgagtgtatttgggtgcttcttaaaacattgtaatactcttataatcagttatctggaaagtttcagaaagggttgtctgcttctcatttacagaaaaaaaaataccttacacgccagggaaccatttaatgtaattaaagaaaactgtataagccaatttaataacaatgtaagtttatgtttactctcactttcagctagtgcactcaatctgctaaaggtcaaactgtaatgtttaatctttacatttctcttgtttcatgtaaatagatagcattccattaacagaatacctgtcaatggactgtaatggataattcaacagtagatattttctaatgtattttttatatcaaattctttgaggaaaagttttttccaaataggaaagtaagttctttccttttcaggaacacttgattctgtgtagtcttttctaatttgtgacagagaatgttgtcactttatttttagattaattacttgtctcagtagaatattagagattcaaggtgacaagagacaggtataagataactgtgacataaacttttctttgaaccatatggagatgaactgattctagaacatttgtgaatttggatttcactcagaaatggctttttgttaatgattatgttcctaagagaatctagtatgtatagtctagagtttttcacttcttaaaaaaataattgcaatacgtaaatccttagtattttgagctacttggttggggatgtctatgtcaatgggaaataattacatttaaaggtttttgtgaattagaaatagtaaattaaacatagatgactgtgtccttaaactaccttaatgagtatgtaagaatggatttgtcatatagatattttgtaaaggttgtaaagttgctgctttcagtgagttaatgatttcataatggtttaaaataagaactcatatacctattatatcctagatcagtagttctcattgtggggaagggtagggttggagaggttgcctccagaggatatttgacagtatctggagacttttttttttttttttaagagacaaggccttgctatgttgccctggctatgttgcctgggctggaatatagtggctgttcacaggctctaactcgggggctcaagtgatcctcctgtctcagcctgctgagtagcttggactatagtcctgcagcaccacacctggctgaagacatttttgattatcacaatttgggggttgctactgacatctagtgggtagaggcaagggatgctgccaagcatcctacattgaaaaggacagccccatacaacaaagacttaacttgtctaaaatgtccatggtgccaaggttgagaaaccctgggttagagtaagataaatggaaagtgcagcataggttcaaagagggagggataacatttgatttggtcgtttgaacagcagaggggggctttataaagaagttggaggattggcctttagagaggaggcatcagattttatagttattcttagatggaggaaactacatgaatgctgatatctcagagtctcctcaaactcaatatgtcaaataatgaactctcgttattcaccctaggcccccttgtcacccagatctaaaacttgggagttattctccactcttccctttccctcagcctctatatctagtgagggactaaggcctgttggtcataactctttgaatagctttcagatcagtttcattcctttctattctcaatgtcattgttcagattctcctctattccttacctttaactggacctgtcagtagttttctaaatgatctctctgtctcaagttttcttcaacttaaattagttagtcctccacactgtagctaaaccattctttctaatatgcaaatctgattgtcatgtgttactaaaacaatgttactaaaacaccttcaagccagtagccagttttcaagccgtacgtttcaaaatcttatttccttattccttgttttgaacattaaaaaaagtaatacatacactatgttttatttaactgtggtaatttttatattttattagttaaaattaaattgctaagattcatccaaattgttatgtaaaactgtggttcattcttttggatggctgtgttatcttgcatcatgtgaatataccatctttattcactttctcactgatagccattttcattcccccctcctcctttttctcttgggaatagcactactatcattattatacatgtctcttgtacttgtgcaaggatttctcttgtgtatatacttgaaaatggaattgctgggttgtatagtatgtcagtgttcaaaccgatttatcatttctgtttccattgacatgtataggagatcctatgaatctatgtgccctccaaaacagtactgtcaaatttaaaaattttgaccaagtgtgtttaaaaaggtatttcgatgaagtctttcttgatttacattcccctgatcacgaatgatgttaacctttcttcagatgtctgttggtcatatgtctttcctgtactgtgaaatagcttttcatttattttgcccattttctgttggttggttgtccttttttaaaaaatagaattctatgggtttaaaaaaatactccttatactaatcatttgttttgtatattttgaatatcttgtttataacttgcctttttgctctttgaggggtgttttgatggacaaatttgtaaattttaatacagccaaatgtatcaatcttgaattttgtagtcaatgatttctgtgtcctgtttaagaatatgtaaaatatattcatctacattttttactaagagttttagttttgtttttggtattaaagttcttaattcatatggaatcgatttttatgtatagcacgaggtggagttccatgttcctgtttttacatatggattatcttttttcagatccatccttacctatgttggggctcagaaaacaatacccccaaatgaaggcctcagcagcagcctcagaagcagaagttttgcactgactttgtcctgccctcctgtctctctgtcccattctcctccaaggctagccgtagaaactagaatccctcttccccaaggaggatcacagaagccagaaccccttttcctgaaagccagccataagacctaaaaatattactctaatttcccctctgcctttctgtgtaaaaactggacacaaagaaatgatctaacctaccttgtttgactgtaggtcttaagacccccattccagagagggccctgccccacagtcagaaggaaggaatacaggctcagagaggcctagaagaatctatttaataggcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttttttttcgagaccgagtttcgttcttgtcgcccaggctggagtgcagtgatgcaatctcggctcactgcaacctccgcctcctgggctcaagcgattctcctgcctcagcctcctgagtagctatgattacaggcgtgtgccaccatgcctggctaatttttgtatttttttttttttccagtagagacggggtttcaccatgttggccaggctggtcttgaactcctgatctcaggtgatccacctgcctcagcttcccagagtgttgggattacaagcgtgagccaccgtgcccagcgtgagtcaggatttcattgtggatttgatttgacttttcctcatgactaatgatgttgaacatcttttcatgtgcttattgactatttgtatattttcataagcaaaatgtctattaggaccctttgtccatttactaattggggtgtcttttcattactgagttgtaagaggtttttttaaaaaaaaaattctatattcaagttttttatcagatatatcacttgcaaatatttctttcctattctgttggttcatctactctgaaacacaaaattaaaacatactgatatcacctattttatctattttcttatgttgcttgtgctttttgtgtcatgtctaaggaagcattgcctaacccagggtcagaacgatttatccttatgtattctgagtttatagttttagctctttcatttttttacatttagctttactgcttatttaagttgatttttgtgtgtcatgtaagatcagggtccaacttcattcttttacatgtgggtatctagttgtcctagcaccattttttgaaaaggtcatttttttcttcatctgattgtcttgtgacccttgtttaaaatcagttgaccataaatgtcaagatttatttctgaactctcaattgtatttcattgatctatatttctgttcttaacccaataccacactgtattgattattgtagctgtgcagtaagtttggtaattgggaagtgtgaattttccgacatttttttcaagatttttggggctattctgggacccttgcatgaatttcaggataagctacacaatttctttggaaaatgcagaatgcaagttgggattttgaaaaggagtgtgttgaatcatcaatttgggggaattttgccatcttatcaatattaagttgtccaatccatgaataggggatgtcttttcatttatttatatctttaatgtcttttaacaattattttgtagtttcctatttttagtttttgatgttgttgtaattggaattttaaaaatttagtttttggattgttcattgctagtgtgtagaaatacaattgatttttataagtgatcatttatccttcaaccttgctgaacttgtttcttctagtagtcttttaaatggattcattagggtgttctatgtcatgtcatctgcaaatagagatagttttacttcttttcaaatctggagccttttatttctgtttcttgcctaattgtccccgttagaacttctagtttcaataatgttaagcagatgctgtgaaagtggacattcttgttttgttcttgaatttagggggaatatattcagtctttaaccattaaatataatgttagctctgtttttttcggtaaatggtctttatcaggtggaagaaattcccttctatacctggcttttcaaatgtttttatcatgaaagggtgttgaattttgtcaaaggctttttctgttctatcgagttaatcatatggtttttgtcctttgttgtattaacatggtatataatattgtttggtttttgaatataagatgaccccactttgcattcctgacctacctgcacttcagtttagtctcatactgcctcggacctctacattccagcctatcaaactataatatgtgctgctcgttgaaagtatcatgctgttcgatgcctcagggtttttctttttttttttttttcctgttaatatccttctttggctttccaccttgtgaactcctattgattctttgtatcccagatcaggcctttatcttttccctttcccctcatcttctacataacagtgattactctatacctctattatagccgctgtgattttgtattgcagtgaatatatttccttcaccctagtatgcaccatcaatttaataacttttctgacaaataaacaccacttcagtaaatgcatacatagatttcaaaaatgttagcattagaagaaaatatgcattgttgaattaaagaaatatgggttatttgtttgcatttccctttttattggttttagagttatttgagtatagtgactttgttgccactccagtagctagtagtacagtgtgtggtacatagtagttgtttagcatattttgttcaattaagcctgcttcttcccatgggtgcctttttgagtccctgcacaatttgtccctttggttttcctctgtgttttccactacttcataaatatataccctgttcttcagggtgtatatctgaacccctcattgttttcctgatttttgtttttattgttttgttatttttaaaaatgaaaaaaattagaaaaaagacatatcttgttattgcttcataagcagatatatgagtattaaactttaacagtttggaaatttgctgtagtttatatatatatatatatatatatatatatatatattttttttttttttttttttttttttttttttgttaagatggagtcttgctctgttgcccagactggagtgcagtggcgtgatctcggcttactgcaagctctgcctcccaggttcacgccattctcctgcctcagcctcccgagtagctgggactacaggtgcccgccaccacgcccagctaattttttttgtatttttagtagagacagggtttcaccatggtctcgatctcctgacctcgtgatccacccgcctcggcctcccaaagtgctgggattacaggcgtgagccactgcgcctggccggtttttatatattcttatactatgccgctagatatgtttttattttagagtagctggccgtttaaaaatatttaggttagcgcttcattaaaattgatttgaaagtactgtttatgatgttaaataagattgacattgaaaatactacattacaaaatgttttgaggattaatatgttcttttaacaaattctattttgaaaatcacgtttgtagatgaagtccaggaaaaatttagagataaatggacatttcatgattaggtttaggagttttctcggtagtatagctctgaattgtttaaaattgtgttttagcatgtcttggtcttactttgtcctcttactgtctgctctcctccattagccatgtgcaaagttaagatcccaggatctgctacctttcagttacgaagtttatcatccttagtaggatcagagcttaaaggcactcacaacagctctctgtattcactgcttcttctcttgcaaaaagcctcatcacttaatgaatgactaaactttctcacatttatcaatataatattgttgccttaaacatctttccattgtagtctattgtatactcttcttctacattgttctttcagaaagttttccttatgccaccattccactgaagaaaaatgtatggatgcaccataacttatttaaccattcctctatcattagatgtttaagttactgtttaatattaataaacaaccaggtgtaattgtgctcctggctttacattgctttctccccagagaaatttaaacttctttaggacagataatgcattctctatataaattctcgacagtgtttggttcaatgctatgactctctgaaatagtttataatagatgcttctcaaatttttaaactttatgggaaagagtgtgacaattttatatactgacttcctatactatttgtgtgtaggacaatgcctctgccatggtgccttggtgatcttgcatgtacccacataggccacataggcaaggctcaaccacaatctgtctcaagtcttgggggaatactctgtgatcctccttgatacatggtaagatagacttgtgaggagctgtcacaaggccatttcctatccacctctgtatcttacaggaggcggcctcaaggcagcttattatctcctattttcattttggtaaggcatgggagtttccttcaggcacagttgtgactataaaatgacatagctgcagtctagaattgactcctcaacaacagagcaacccactgtgtgtgttgtctttcatttagtccctccagtttgggtttctcttgtaggactagggacatggggagctgataccatactgatcatgccttctctgcctgtgttagtaataaaccatctgaatccatttggtcttgtcttactggcagctgccgccgtgctgatgtgtaggggctgcttgaccacttaatgtaaacaaatgggattttttttttttccagtttgtggaatttgtcattactttttaattggtcaatttattgtaaattgcttttaatttcaggattcagtggttagtgctttgctatcaaatagctcaggtaaggatggtccttgctctgtaaatacagtattattttagggggtacagcatgcagctataaaattagtcttaatctgaataaatcaaagataaagcaattagttttgtttagtacagtggcctgcacttggttttcttttttcttcctctcttctcaaggactacttttgttttgcaatctgaagcctgcttaagttgtcctggagagtcagttggatgcagacctttctcgtattatattagactttcctttctcatgcagtagaaaggtactaaggtatcttaacatgcaaataaaatgtatattgtatacacagatctacctgattttcagtggctggttgaccttgacctaggcagaaagatcaaagtcaaactgttgccagtggagggtgtccaggttcttggtgttttgaacaaagaattggacaaaatgcacaaagcaaggaaagaatgaagcagcaaaagctgagatttatcgaaagggaaagtacactctacagggtggcagcaggccgagcagcctctcacagccccgatacagaatgttcttgggtccaaataccctgctagaggattcccattggccactttgtgtttacctcatataaatgaagtgatggcctgcaatcaatctgattggttgcagaaagcgatgaaacagagcctaaagtgaagttacaaagctgcactgctatgttaacgaagacttggcgtgcaatcagtctgattggttgcaaaaaacaaacaatcagaggctgaagttacaaagttatacgcctatgcaaaagtctgattggttacagaaagcaaccaatcagaggtactttctatttcccatctgccatgcagaaatagtgggggtttgccaaggggctagtctctggtccttttgttacttaggtgtggaaagttagggttttcctttcagtttagttctaggaagtcagcgtgaaacggccctgcctccagatcctatactcctgcctcaaaactaattgaacatcatcaattctgatgtactagacatggttaagatacatgttttgccattggttacttcattaatcagaataatcataacaattcagatattaggggttttttttggtttaaaaaatgttacatgaaagcatgattttgttgaattaattaattaattaacttttttattctttgagacgggggctccctctgttgcccaggctggagtgcagtggtccaatcttggctcactgcaaccccatcaaaaactgagcgaaggatatgaacagacacttctcaaaagaagacatttatgcagccaacaaacataagaaaaaaagttcatcatcacaggtcattagagaaatgcaaatcaaaaccacaatgagataccatttcatgccagttagaatggtgatcattaaaaagtcaggaaacagcagatgctggagaggatgtggagaaataggaacacttttacactgttggtgggagtgtaaattagttcaaccattgtggaagacagtgtggcaattcctcaaggatctagaaccagaaataccatttgacccagcaatcccattactgggtatataaccgaagcattataaatcattctactataaagagacatgcacacgtacgtttattgcagcactgttcacaatagcaaagacttggaaccaatccaaatgtccatcagtgatagattggataaagaaaatgtggcacatatataccatggaatactatatagccataaaaaaggatgagttcatgtcctttgcaggaacatggatgaagctggaaaccatcattctcagcaaagtaacacaggaacagaaaaccaaacactgcacgttcccactcataagtgggagttgaacaatgagaacacatggacacagggaggggaacatcacacactggggcctgttgtggggtgggaggccaggggagggatagcattaggagaaatacctaatgtagatgatgggttgatgggtgctgcaaaccaccatggcacttgtatacctatgtaacaaacctgcacgttctgcccatgtatcccagaacttaaagtataataaaaaaattgttatgagtttgggggtacaagtgtagttttgttacatggatatattacatagtgatgaagtctagactattagtgtaaccatcactcgaatagcgtacattatacccattaggtagtttctcacccctcaacccgctcctaccttcctacatttctgagtctcagggttctgcaggtacatagaagttgccaggttttcttgccatcctcgccattcgaaattcagttctgtacatctgcctatattcgttgtgatagtgcttcgctttttcatagataaccttcctccttgccttttgaagtatgttttgggcaaacttctttctcaggcacttgatcttcagttctgtaaaattcctttactttttcttaagggtttctggcacagcaggaaccttcttcatcttctcttctacaccctccatggttccagctggaaaaagaggatgatttcttttcttttgggtagatacctaatagtgggattgccagatggaatggtagttctatttttagttctttgacaaatcgtcatactgttttccccaggggttgtactaatttacattctcactaacaatatataagcgttctcctttctccatatcctcaccaactgttattttttgactttttagtaatagccattctgactggtgtagggtggtacattggctgtctcaaaattttgtctgttttaatttgcatttctctgatgcttagtgatgttgagtatttcttcatttcatatttttcattttttcatatgcttcttggccatttgtatgcatacaacaaaagcggtgcttgcttattgtagaacatttggaaaatagaagcatagggaaaaaaatacaaattgcttctcattccagcaaccttgaataaacattaatattttggtatatttcctttatattcccaacactcatcatcttgcacatacctgtaggtctttataaatttatgtatggtctttaaagaaaactattgctgcacttggtgtatatagttttacattttaaatactctagttattatactgtgagcatatttccatactaaggaatcgagtctataatatgatttttaaaggctacaggatattccatgttaaagatataaaaatttgtttagcctttatcttattgttggacatttaagttgtttctaatttttactattttaaataatcctgaaatatgcatattttttacatatctctattaggtttcaatcaaaaattgctattaattgaattattggatcaattattatgaacagttttaaggaccttgattcactttgccaaattgcacttcagagaagttacctcattttgtattcccaccaatgatgtatggaagtgcctaattcaaaatagccttgccaacaccaagtgatagttttaaaacctttaaatttgattaatgaattatgttttttttttttttttttttttgagatggagtcttgctctgtcacccatgtcacccaggctagagttttgtggtgcgatcttggctcactacaacctctgtctcctgggttcaagtgattctcctgccttagcctcctgggtagctgggactacaggcacacggcacctcacttggctaattttttatttttattttttgtatttttagtagagacggggtttcatcacgttggctagtgtggtcttgaactcctgacctcaagtgatcctccggcattgacctcccaaagtgctgagaatacagacgtgagccactgcacctggccaaattatgttatcataatttttacgtttattttgattacagtgaggttgaagatattttcatatgcgtcttggtcgttgatagttttcattttgaaactgtttatgtccttggcccaggttttatctatgagttgttggtatctttttgctttttgatagactgaagtttttccttctttttatgtaacttaacctagaaatctttcatgtgtgaattctttctttatattaacactttgaaactccttccccattctaatattaggtgactagtcactataatgtttttcttaaagcttcattttcatgtttatctttttcttccatctggattttattttagtaaaagttatgtgataaagcaatagtatttgtcttgaaaatatagttattcaatagccatttaataagtaatactacattgatttgaaatgacaaatttataatacattttataatggttgaagtatagtgccattcttaaatatctctttgatgtttgaatgctgttacagtgattcattagtcattatttcttggtgaaactgaaaaacttactagaatttcctacagataactgcatagagctgcccctccctcttcttttaaataaggtcttgtctttccatgtggcttaattgttgcgagactcacagtcctttccttactgagcatgcacgtatctgccctctggttagcagctgtggtttccccttgcaatatctgtttttgtttgcacctttgcttctcaaggttcctgtgctgaaaatgagcctttcattactggttgcttcaggtcggtgagatctccttgttattgtttatcataattgttaactttgaagcatttttttccttcattttttccaatgtctacaagttgtttttttctctctgctgcacttatggttaaaattttaattcatcatggagtagcttagaaattctgtaatccatacatcttacttgttcaacaaggtctcagtgttatagactgttcattattttgtcctgcacaacacccttctagggaatactgaatcaagaaatcacctgtctttgcagagggcatctgttgaggcagatgccagagccatggggttgtcatttcccatcaggctccatccagtatcagtctctaatacttcaaagacactttccatccttgcatccgacagacagctgtggtgccttctgttttcttgctgcttttgtttctagtcttaacagttcttttagatagaaaaatagatgaggaattgctaacatttgagaacatattaatcagattttacatactgtaattgtgctcaaatttgagtaataatagttaccaaagaacagagaacatttaattttttcattttcatgttaggaaataagtatctgagttggctgattttatgcactctcctgaagacatatttctgctatatattttttatgttacaagaaatgaatataatggtctaatttccatcattttattttctatctttatgaacattacctatcattatgtacaagttgacaattttcccttcatttctattgattatttcttctagggattttaggttgttgcagaatatttagtcattaccaatagctctgaaataggaattaagtgattttggcactatttaataggtagtagtagattcagaaatgcagttcagatcaagtctagtgttcatctcccctcttttttagtcagtaagacttctgtgaactttgagacataccccaaggatgatgctgtattggtctagccccaagagctttatattatagaaactacaattttagtagaactaaatggaggtgattctttttgcattctttcactgaagtgttactatctaagcaggtattatttggtgttggagtggaataagaattgatattacctagagttggtgtctggttgagcttttgatttaccctaacatctcatgcttagtttatagttaatgtttaatggaattttgtcaaatggatgataaaggctgtgagtcaagtcaggatgctacctggcaaatatggagaatgaggcttggaaggtgaggatcagaatttgcttgcctctatcacagactctggaaatgcaggacgacagataatttgatattaagatatttgaatattttaccttgtatgttttccgtggttaggctgcaacttctaagccctgctggaaaaggaatggtactgttcaaagacagttcaccatggcttcatgtttctgcgcatcttacaagtgagacactaactgccctgtgttctgaactttattttcaatgatgttggtacagtgaacagctttgcaagataaacctactgtttgccttcaaaacaaagtgcagactggacgcagtggctcacacctgtaatcccaacactctaggaggccaaggcaggaggattgcttgagcccaggagtttgagaccagcctgggcaacatagcaagaccctgtcctttttttttttatgagacaaggtcttgctctgtctcccaggctggagtgcagtggcacaatcggctcaccacagcctcaacctccccaggctcaggtgatcctcctgcctcagcctccgaagtagctgggactataggtccatgccactacactcggctatttttttgtattttttgtagaaatggggttttgccatgttgcccaggctggtctcaagctcctagactcaagcaatccaccctcctcggcctcccaaagtgttgggattgtagatatgagccactgcccccacccaagaccctgtctcttaaaaaaaatagccaagcttggtggtgcatgcttgtagtcccagctacttaggaggctgaggcaatagcactgctttagcctgggaggtcaaggctgccgtgagctgtgatcacaccactgcactccagcctgggcgacaaagcaagatactgtcttaaaaagcaaacaaagaaaacagaaacaaaccaaagcaaagggcagatttgcttgcatccttggacaaattagatagtatttctctccaaagcaaaagataatcatgcttaatgttgaataaaataaagataatgtctcccttagaataaaaggcaggcatgcttactatgataaaagatttgggttccctcagctcaggttcctttcctataatgtgataatactgcatgtgcatgcatccatctgggcccatcagtgttgcccccatgagattttggggagtacggggaactgacccaaatatactgttcatgccatttgctgtgctgtgagcaataaaggcctctgtctctcacacgggagtctcatgtcttctgctagcatctatacaacagtgttaggctaacatactggcttacaagtagggcaaaatccgacccttcagagttcttgacaggtactcagcacaatgcttttggctataagatgttatcctcctttagacaaaatttgtttgactaattttctttaatccttgtttattgaattggttaaaaatattgaaaagtaataagagcccatctctttaaggggccaagaaagctgtgtgtcatctcagatgaaacaattttgaattggtaaattgggaaaagctgagggctttataatggtgttcattattctctaaaacaaaaattgaacctagaagtaagatttacattctgcctcctattgcaagaagcaatcttgggggggtgtgtggatgttgttagatttagaattcttctgaccctggtgtgtggttgcagtgggacagaatatttgagatgtgggacagaaggccacagtagtgtgttaaaggagtggaaaatcacacatagaacataggctttgaagacacatgagtttggaaccccagtgctgtcagttattactagcttttcattttttttacctttgggaaggcatgtcattcagtctatctttgcttcatatgtgtattagtctgttttcacgctgctgataaagacatacccgagactgggcaatttacaaaagaaagaaatttgttggacttacagttccacgtggctggggaggcttcacaatcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcaccctctgaagccacggcccaagctgtaccttggccccttatagtcatgcctggagtggctgggacacagggcaacaagtccctagcctgcacaccacacaggggccctgggactggcccacgaaaccattttttcatcctaggccttcagtcctgtgatgggaggggctgctgtgaagacctctgacatgccctggagacattttccccattttcttggggattaacattcgggtcctggatacttatgcaaatttctgtagccagcttgtatttctcctcagaaaatgggattttcttttctatcacattgtcagggtgcaaattttccaaacttttatgctgtttcccttttaaaactgagtgcttttaacggcacctaagtcacctcttgaatgctttgctgcctagaaatttcttccaccagatactctaaatcatctctctcaagttcaaagttccacagatctctagggcaggggcaaaatgccaccagtctctttgctaaaacaaaacaagagtgtcacctttgctccagttcccaacaagttcctcatctccatctgagatcacctcagcctgggtttcattgtccatatcattattagcattttggtcaaaaccattcaacaggtttctagggagttccaaactttcccacattttcctgccttcttctgagccctctgaactgttccaacttctgcctattacccagttccaaagtcacttccacatttttgggtatcttttcagcagtgccccactctactggtaccaatttactgtattagttcattttcatgctacagataaagacatacccaagactgggcaatttacaaaagaaagaggtttattggacttacagttccatgtggctggggaaacctcacagtcatggtggaaggtaaaaggcacatctcacatagtggcagacaagagaatagagcttgtgcagggaacctcccctttttaaaaccatcagatcttgtgagacttattcactatcatgagaaaagcatgggaaagacttgcccctgtgattcaattaactcccaccaggtccctcccacaacacgtgggaattcaagatgagattttggtgaggacacagccagaccatatcagtatgttaaatgagaaacagtaactagcttacaaaattgttaaaaggattagaaataatctatgcaaagtgcacagtactgtgatctagcatatagggtgtatgtgtataatatttgcctcaattccacttaggttattcttgatgtgaatttagagttctgatttcaagttatttctccattaactcccatgttccttcaagcagacaattctatggtgattactctaatgatgaagatgtgttcaaacagcacacttcattattaggaattttatcagaggtaaaaatcacatggccctctccttaatgtgtctgtttaatttccctctgctttcctcttataaggatacacgtgatggcatttttagggccagagataaaagtgtgtcaggctttcaaatattacctaggatttttttaaaaggagagactatggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaacctttagcatataagataacactcacagattccagaattagggtctgatatctttgagggccaccattcagcctacaacaggaagataaatacacattttaatgtccttttttatgtggaaaaggtgaaccatttttataattgtcttttcccaagtgctgtttgttgcctaagaaggtaggctttgaaattgttgtgaagtgaatctcccacggaggaataagtgagcagttttccgatttttatttatttttattttttgaaaaagacagggtctcactgtcacccaggcatgagtgcagtggcatgatcatggctcactgcagcctcaacctcctgggctcaaaccatcctcccacctcttagcctcccgagtagctggaactacaggcatgcaccatgcccagctactttttgtatttttttgtagagatagggtttcgccatattgcccaggctggtctggaacacctgggctcaaatgatcctcccacctgggcctcccaaagtgttgggattacaggcatgagccaccgactgcacccagctgtttttttttcccccgatttttaggtggaatttttatttatttaattttttgctggaactcagttaaaataccagttttgcatgtatttctcaattatttgttcattattagtcatattttatttttctagttgccctagtatacatgttaattgatttttaatgtttaaaaagctcctttattgtatatcacaagataaacattttaaatcagtttaaattttattaattatagctatataaaagttaatcttcacttttttgatggaaaatatgagatgctgttagtgtgagatagttcaagaaattaagatacaaatagttttatgttatttcccatttttctttccaaggttgagtttttttttttttttggcactgttattgtatttacccaatgcttaggatgtttatactgattttaaatctgaaacacctaagaattagattttgctgagaccagctcagttgtggagaccctaacccagcggcgctagaggaattaaagacacacacacagaaatatagagtgtggagtgggaaatcaggggtctcacagccttcagagctgagagtcttgaacagagatttacctgcatatttactgacagcaagccagtgataagcattgtttctatagattatagattaactaaaagtattccttatgggaaacaaagggatgggctgaaataaaggggtgggtctggctagttacctgcgataggagcatctccttcaggcacagatcgctcatgctattgtttgtggttcaggaacacctttaagcggttgtctgccctgggtgggccaggtgttccttgccctcattccggtaaacccacaaccttccagtgtgggcgtcaatgccatcacaaacatgtcacagtgctgcagagattttgtttatggccagttttggggccagttcatggccagatttgggggcctgttcccagcaagatttattattctttatttaactccattaaattagaataataattataattttaagtggtgtttactaaataaatacatgaaatcatccagaaaatagtttatgaatgcacatttaattaaattccctgagggagcttctaatattactttgtaatttaactaaataatcttttatttggaggggaacgaacataaagaagcatgaaaaatgtgtagattagtaatgtcttgatattatttaaatcattaaattattcttgttattaatactgatgttttagtatatttttctgtccctttttggtagtttatttgcctttttatttcatttttttttgcatttttttttgtgagacagagttttgctctttttgcccaggctgaagtgcaatggcgtgatctcggctcactgcaacctccgcctcccaggttcaagtgattttcctgcctcagcctcccaagtagctgggattataggtgcttgccactatgcctggctaattttttgtatttttaatagagacagggtttcaccatgttggccaggatggtctcgatttcttgaccttgtgattcacctgcctcggcctcccaaagtgctgggattacaggcgtgagccaccatgcccagctgactttttatttcatatgttatttttcagaagttttaggtttacaaaaaaattgagcagatagtacaggtaccccatactccttttctccagctcatagttttcctatttttagcatcttacatttttgtaatgtattttttacaattaatgaaccaatatatggtacacttgatgatgatgaaaattgatgaagctatactttattattaaagtctgtacattaggattcagtctttgtgttgtatagttgtatgtgttttgacaaatgcatgtgtcatgtatgcatcatcacagtatcacatagaagagtgtaactgccctgaaaattctgtgatccatgtattaatcactctttgatatggtttagctctgggtccccacccaaatctcatattgaattgtaaccactatgtgtcaggggagggacctggtaggaggtgattggatcatgagggtggtttccccgatgttgttcccatgatagtgagttcttatgagatctgatggtttataagtgtgtagcattctcctcctgccctctgccttgtgaagaaggtgcttgcttcttcttcaccttccaccatgattggtttcctaaggcctccccagccatgtagaattgtgtgtcaattaaacctcttttctttataaattacccagtctcaggtggttttatatagcagtgtgagaatggactaatacagaaaattggtactaaagaagtggggcattgctataaggaaacttgaaaatatggaagcaactttggaactgggtaatgggcagaggttggaacggtttggagggctcagaagaagacaggaatatatgggaaagtttggaactctctagaaacttgttgaatagttatgaccaaaatgtgatagtgatatgaacaacgaaatccaggctgaggtggtctcagatggagatgaggaacttactgggaactgaagtaaaggtcactcttgctatgctttagcaaggagactgatggcattttgctcctgccctagagatctgtggaactttgaacttaagagacatgatttagggtatctggcagaagaaatttctaagtagcaaagcattcaagatgtgacctggctgtttctgaaagtgttcagtcatatgcattcacaaagagatggtctgacattggaacttatgtttaaaaaggaagaaaagcataaaagtttggaaaatctgcagcctatatggtggaaaagaaaaacccatttactgggaagtaattcaagcccgctgcagaaatttgcataagtaaaaaggagccaaatgttaattgccaaaagaatggggaaaatgtcttcagggcatttcagagatcttcatgacagcccttcccatcacaggcctggaggcctaggagggaaaaatggtttcatgggctgggcccagggccctactgctctgtgcagcctcatgacatggttccctgtgtcccagccactccagcttcagctgtggctaaaaggggccaaggcacagctcataatgttgcctcagagggtgcaagcctcaagctttggtggcctccacatggtgttgggcctgtgggtgcttagaagacaagagtggaggtttgggaacctctgcctggatttcagaagctgtatggtaatgcctgaacgtccaggcagaagtctgctgcagggccagagccctcatgggtaacctctactagggcagtgtagaggggaaatgtggggttggagactcacacagagtccccattggggcagtgcctagtgaagctgtgagaagatggccactatcctccatacctctagactgacagtttgtaccgagcacctggaaaagctgcaggctctcaatgccatcccctgaaaccagcgacgggggctataccctgaagagccacaagggtagagctacgcaaggccttgggaacccaccccttccatcagtgtgctctggatgtgaggcatggattgaaagaagattattttggaactttaagctttaatgacttccccattgtattttggacttgcatggggcctgaggccctttgattttggccaatttcccccatttggaacgtgtgtatttacacaatgcctgtacccccattgtatataggaagtaactaacttgattttacaggctcataggcaaaatgggacttgccttgtctcagatgagactttggagttggacttttgacttaatgctggaattagttaagacatttggggactgttgagatggaattttgcaaatgtgttgcagtgtgataaggaaatgagatttgggaagggctgtggcagaatgatatggtttagctctgtgtccccactcaagtctcatattgaattataattgccatgtgtcaggggagggacctggtgagaagtgattggatcatgagagtggtttccctcatgctgctctcatgatagtgagtgagttcttacaagatctgatggtttataagtgtgtggcagttcccctgccctgcctgccatcttgtgaagaaggtgcttgctcttcctttgccttctgccatgattgtaagtttcctgaggcctcccagctatgtggactgtgagtcaattaaacctcttttctttataaattactcagtttctggtagttctttacagcagtgtgaaaatggaccaatactctcttcctcttcccttattccctcttttcctcccaaattatggcaaccattgatctttctactaccaccatagttttacccttcccagaatgatatttactaggaatcctagcatatgtagacatttcagactggcttctttcaagaagcaatatatgttaaggtctctccatttcttttcatggcttgaaagcttgtttcctggaagctattccattgtatggatattccacagtttatccattaacctattgaaagatgcatcttgtttgcttctaaattttgacaattatgaataaggctgctataaatgttagtgtgaagactttgtgtagacattagttttgaacttatttgagtaaatacccaggcttgcaattgctgaattaagaccatatttatctttgtaaaagcataccagactgtcttccagtgtggctgttcttgttttttcactaaaaatttatttatataatttatggcatacaagtgcaaatttattacatgcatagtagtcaagttaggggattcagagaatctgtcacccaaataacatacattgtacccattaagtaatttcttattatatacccctctcccactctctcacccttctgagtctccattgtctatcactctgctctctatatctatgtatacaccattttttagcattcactaaaaaatgagtgagtgacaacatgtgatatttttctttctgtgtctggtttgtttcacttaagataatgaccttcagttctatccatgttgctgcaaaagaccaatgctttggctatttggactcttttttggttctatatgaattttatgattgttttttctaattctgtgaaaaatgatgttggtattttggtagggattgcattgaacctgtagattgctttgggcagtatggtcattttaacaatattaattcttctgatccatgagcatgagatatctttccatttgtttttgtcatcttcaatttctttcatctgtgttttatagttttccttgtagagatctttaacctctttggttaaatttattcctaggtattttattttctggtaggtgtggtaaataggattgacttcttgatttcattctcagtgagatcattattggtatttagaaatgctactgtgttttatatgttaatttttgtatcctgaaactttatcaaatctaagagttttttggtggagtctttaggtttttctagatataagatgatatcgtcagcaatctgcgatactttcacttcctcttttttgatttggatgtgttttatttctttctcttgcccgattgctctggctaggacttccagtactatattcaataacaatggtgaaagtgagcatctttgtcttgttttagatcttagttggaaggccttcagcttttccccattcagtatgatacatgggtttgttgtatatggcctttatttttttcaggtatgttccttctatgcctagtttgttgagggtttttttaccatgaagggaagcttaaccttatcaaatgcattttctgcatctattgagatgatcatatgttttttgtcctaattttgtttatgtgatgtatcacatttattaatttgcatatattcaaccatctttgcatccttggtataaaacccacttgatcatggtgtatgatatggtttggctctgtgtccccacccagatctcatcttatagctcccataattcctatgtgttgtgtaagggatctggtgggagatggttgaatcatgggggtgggtctttcttgtgctgttcttgtgacagtgaatgagtctcatgacatctgatggtttcaaaaacgggaatttccctacacaggctctttgcctgccaccattcatgtaagatgtgacttgctcctgcttgccttccacaatgattgtgaggcctccccagccatttggaactgtaagtccaataaacctctttgttttgtaaattgcctagtcccaggtatgtctttatcagcagcatgaaaatgaactgatacagtgcattatctttttgatgtcctgtattcaatttactagtattttgttgaggattcttgcatgtatgttcatcagggatattggtctgctgttttccttttttggttgttgtgtcctcgtccagttttggtattagggtgatagtggcctcatggaaagaattagggagaatactctcctcttcaattttttggaacagtttcaggaggagcggtattccttctttttatatttgatagaatttggctgtgaatccctcagccaagctccctcaacaatccctgagcttgtctttattgggattttttttttttttactactgattcagttttgctcttcattattggcctgtttagattttctatttcttccttgttcaatcttggtaggttgtatgtttccaggaatttatctctttcctctaggttttcttgtttgttgagtatatagttgttcataatagtttctgatgatctattgtgtttctgtggtatcagttgaaatatttccttttttatttctcattgtgtttatttggttcatctctcttctaggttagtctagctactggtttatcagatttatttatctttttgaagaatcaactctttgtttttttaatactttgtatttctttggtccctatttcatttagttctactgtgatctttgttatttcttctgctagttttgagtgtggtttgttcttgattttctagttttttgagatgcattgttaggttgataatttgtaatctttcttttttttgataataggcatttaatgctacaaatttccctcttaccactgcttttgctatatcccacaggttttggtttgttgtgtttccattttcatttgtttcaaaaaatttttaatcttttgtattaatttcttctttgatccaatgattgttcaggagcttgtgtaatatccatgtgtttgtatcgtttctgaagttcctttttgtattgatttctatttattccactgtgttatgagaaaataattgataggatttcatttttaaacatttgttgatacttgttttatggcctaacgtggtttatcttggagaatgttccatgtgctcatcgaaagagtgtatattctgcagttgttgggcagaatgttctgtaaatttgttaggtccatttggtgtaaagtccaatttatatctaatgtttctttgttggtttcctacctggatgatctgtctaatgccgtgagtggtgcgttgaagtctcccaccattattgtatctgtctatctctctctttaggcctagtgatatttgttttatggatctgggtgctccagtgttgggtgcatatacatttaaaattgttatagcctcttgccagattgatccctttattacagaatgaagttctttgtcttttttaaccgtcttttatttaatatctgatttaattgatgcaagtacagctagtgctgctcacttttggattttgtttgtgtggactgtctttctattcctttacttttggtctatatgtgtctttacaagtaatgtgagtttcttgtaagcatcatatagttggattatgtttttaaaatctattttgccaatctatatcttttaaatggggcatttaattcatttattttcaaggtttatattgatatatgtgagggtttgttcttgtcgtattgttaattgttttctagttttataaattctctgtttctttttcttggaatgtttgcctttggtttggtggaattctgtagtggtgccatttgattcctttttcttcctcctttgtgtgattactttaccagtgagttttatacttttgtgtgtttttatgatgatgaatatcgcttttacttccacgtttaggacttctttgagcatttcttgtagggccagtttagtggcgatgaattcctcagcatttgcttgtctctgaaagacttcatttcttcttatttatgaagcttattgctggatattgagttcttggctggcagtcttggttttttttatttcagcatttttaatatgtcattcccttctcttctggcttttaaggtttctggtgagaagtctcatgttagtctaatggagtttccttatgtaggtgacagggtgcttttctcttgctgattttattttattttattttttctgtgaagctgttctttatttcagggagaggacaggacagggagctcagtctttcatagcagcaactttcctcgtgatggccaggacattgctcagctcctcccgcttcctcttggtgtggatgtgtgtccccacccttttcttgatgaacttgagggcttgtttgtccttggagaccttcagtaactccatggtgcaccgctcgtatggggtgaagccacatacctcttggatcatgccccgcacacacttggtgtgtttggtcgggcgcccaaggctacgactgtgtctgggcttgctcaaattcttggtcaacttgtggcccttgttgaggcccacgaccatagtgtagcacagaaccattgctgctgctctgcaatggtggctgtggtggaatgctgtcttgctgattttagaattctttttactttagacagtctgattataatatgctgtggcaaactcctttttgcattgtgttttcctgggaatcactgagtctcctgtgtctggatgtctaaatcttgctatacttggaaaagtttcgtttcttattttgttaaataggctttctaagccttttaatctctcatatccctcaggaataccaataatttgtaagtttggtcattttatgcagtctcaattggcacatgtatacctatgtaacaaacctgcatgttctgcatgtggatcccagaacttaaagtataataaaaaaataaaataaagcaataagcaagttcaaaaaaaaaaaaaaagaaaaagctttgttcattctttttctttatttttgtctgactggattatttcaaaagacctgtcttcaagttctgaaattctttcttctgcttgatctagtatttcaaatgtattttgtattttcttcaatgaatcctttagtttcggaatgtgtgtgtgtgtgtgtgtgtgtgtgtgtgtgtgtgagagagagagagagagagagagagagagacttgttctgttgcccaggctggagtgtagtagagagcgagagtgagagagagagagagagagaaagagagagagagactttttcttttgcccaggctggagtgtagtggtgtgatcatagctcagtatgacctcaaacttttggactcaagtgatcctcctgcctcagcttcctgagtagttgggattacaagcatgtgccaccacgcctagctaatatttgtatttttagtagagacaggttctctctatgttgcccaagctggtcctaaacacctgggctcaagcagtcctcttacctcggcctcccaaagtgctgagattgtaggtgttagccaccacactcgggctttttatcttttaaagatatttatctccatgttataagtttttatttgtattctgaattgattttctgagttctttgtattggtttttagatttctctggcatctcattgagcttctttaaaatcaatgttttgaattctttatctgggattttgaggatttttttttcttttttggttaggatctactgctggagaattattacattcatttgaggccataatattacttagctttttcatgttttctgtatctttatgttggtttctgctcatctggcttcatagttacatctttttaaaaaaataactttcacgtggatgggggacttttttcttgaagatatgacaatgatgttcgttgggtaaggccttctggctttgcttccaggtgcatgcagtagtgaagactctgtataatttgtatggctatccttattctgttaatgtgttgttcttggtggggcctgtggtgaagttgtgcttgtgactggaatgcctgatgggcccatcatcaggttgtaatggtagcagaggtgtgctaagtatgtctatccttgtgacctgggacagcatatgctggctcctgtgttggcagtttccaggcaggctcatgtttgggcatctgggtggcttcctcagatgccagttttagtagcagtataccaggcagataagcaggctctcaagctcctgagcagttggagtagtgtgggtgatagaggtagcagtggtggtgagatagtctccttgttcccatgcactgtgctcttgtgttggaagtggttgcaacaggctgtgcaaactggcttctaggccagaaggtggtgctttcaggtaagagccagctgagactgtagaagcagggtgtttatgctcagtctctgtccccttggtgctcatgtgcccctggtggtagattgggttgtggaacacccagaacctggcccccacagttcatgttggcatagggttaggagggtgaagctgggtggatccagactgggcaagcttgtactcaacacctcccaatggcaagtgcgtgcatgagccatgatgtgggggtggggcaggcagtgtagtcgtcatgcccctggtgaaatgcttgggtgagaggtgactgctgctgtgctgaggtcctgccatgggtgccagggaggatgagaccactgctgtccctccctcatcccatctgtggcagccaacctggctgttctgttagtatggcagtttgcacccagcccataattcagccatgagccatagaagccagcacccagctcaagaccaagcctctgcagtaactcatcctgctcaggattggagcattgggagcctggttccagtgccagaggctggagcccatgccatgtccgtttcttagttttgattgtgggattccccattgatccccattcctgctcaagcccctgctccacaagatgcaacctgatcttccccaatggccaagactggtgctgcagattcccaggaccactcatagtttgctaagagctaggattaagaatcgcatcttactgtggctacttagttctcaggaattgtgtgggacccagggcatgttgcctccttgaagcagttccttctcacagtctcttggatgctccctaaatcagattcaggatttgggtgggtcagggtgctctgctgtggcctggactgtatgattccccagtgggaaagtggactgcagaaagatactcactcactctctcttagggattcattgccagttcccagccggtcttgaccacgacaggctgtctgcttttcttctcattcccagattttggagtttcctttcactttttctgttgaaccctgtgttccctgttgggtaatgtattcaaagtgtgattgtctacataccactttggtttttctaagtggatgaggtgtgctggaaatgtttttagtcagctatcttggaaaacaaaggtcatcctcctgtcactttttgaacttctttggttactgtgttttctcatgactattattttcagccttctctgcttgctgttttttctctactcactaagtgttggccttcctgatagcccattcttgatctctctaattcaatactctgatattaggtgatgccttccatttctgtgatttaatagaactaaccatattcctacaactttcaatttttttttttttgagatggagtctcactctgtcactcaggctggagtgcagtggcacgatctcggctcactgcaatctctgcctcccgggttcaagcaattctcctgccttggcctcctgagtagctggaattacaggcgtgcgccaccacgtctggctaatttttgtatttttagtaagagacggggtttcaccatattcttcaggctggtcttgaactcctgaccttgtgatccgcccacctcggcctcccaaagtgctgggattataggcatgagccactgtgcctggccacaactttcaattttatatatccatcccagacttcacttaggagatcaagattcatctgtctaatgcccatttaacagcccctctttgagtctctctcagatgtctcggtttatacagatataaacttgaacccttcattgcacctctgtttcaaaaaagcaaaaacctcaccagtagaagaagctacaaaaatcctgttacactcccactgtttattagatattattattttagctgtccaggccagaatcctgggtgccattcttgattctttcctctcatttcttccacatacctagctctttgccatcccctatgagtactaatttcaaaatatatttcaaattttatccattttctcttaaccctattcttgcaatcttaatacaagttactatcgtctaatctctgagaccactatattatttatgagtacttaatactaggtattatacagaataacaaactgggcatgattttgtttttaggatttcaaattacttgtaaacagtaattttgaactcccagaattctgaagttacaagaataagaggtaaaaccctaaatataaagaaacatatcctaaactaaaaacagtgacttcactttcttccccaatagaactgtgtgatgcttgggtatccagaggaggtaagccagaatattgggaaacatttatttctagtttagattttggtttctagtaattctattgtttttttagttattcagaattttatggtgggaggaggaagaatagaaattttcatattatataaacatagctattttttgccagttatacaattttacataaggttaagaatgagaatatatatctctctccttctctatatgtatctctatatattacatatatagtaatgcatatgttaatgttctgaataaggaatttactatattgctaagtgaataggcctcatcccttggaatgaggaagttgagcattactgagaggaggttgtttttatgagggcagaccagatgctaaatgaggtacattgagctaggctggatgctcttcctgacagaggcacaaaattttcttacatttttaactaaataagtatgagctagtgtgagcaaagtaaatttctatgataaggtaactaacttgatagttactcaggtagtttttgggggtttgcacctttggggacattatttgtctgccatgaatagaggttgttgctggcatctagtgggtagatgccagagatgctgctaaatatcctacagtgcccaggatagccccctacaatggttatccagaccaaaaaggtccacagtggtggggttgagcaactctcttctagagtatttatttttcaacccactgctataatgtcctaagtatttttcaaaatttcatttaacaaataaacccttaataggagtaatggttataacgattccatgattttatttttgtgaaaatttaaatgaatggaagtatatttgtgtgtacttgcaataatttaggagaggaatgaatcaaggatgaataccaggtttctggcttgagcaactcaccaggaggatgttgttgacattgagatgagaaaaaaaaaattgtgggaaaagatcttcatttcagatgttatatttgtagaatttgaggtgcctgagagatatcaaggtgaagtcctgaagatcagaacataggcttttagacatatccttaatttgcaattcatcggtatgtaaatataatttggatctaggttggatgaaatcacccagtagagtatcttttttttttccatttacttttcagatttactgagtgaacataatttttcataaacatttgatctaaatcatttttgttgttgttgttgctggttgtttggtttttaatactgggaacacagagattcagtttgaaagataccctaaaatcttaagagtagtatacaccaatccctcccactctccacccacaatctagttggtttaagtgagcagaatgatccatttttccattttaggtgagcagatgtttatgaaagatcttagaactgtttgcctcatttatcaggaacatttacaagggaagaagccattaatcgtatttcaacttgtaaatagaagaagactaagactcaggttcatatcttatacttttaacaagaacttgttgaaagaaacattaacaatttcaaactaattttaagtttttcctcacaaaagcataaaaatggagatcttaacaggaaattcttaaaaggtaaaaacaactcctacttatactagtccttgggtagttaacatagaacaggttcttctttttgtttctttgaaaaggaatttttgggcccaagtctgttcctgcttagtatctgctccggccttcccccctctcgaagcggcctccttgacggcctccgcccctgggcaccctgcagcctgaccggctgtaagaatcatgcaggggagggctgcccgtttccatgggcagagggagcccacgatccggtctgcctacccggtctcgacccctcgagtagcggtcgctccggccgtaactgttgctggatctgtcgtggtcgccgctgtaggcgtcaggcaagctgccctggtactcctcgtagtggcctcctcctccgtagcggtcgctcaggccgtaactcttgatggaactgtcgcggcccccactgtgggcgtcaggcgaggggcctcggtactcctcgtagcggcctcctcctccgtagcggtggctccggccatgactgttgttggaactgttgaggccgcggcccccgccgtaggcattgggcgagcggccttggtattcctcgtagcagcctcctcttccgtaatggtcactccggccatagctgttgctgaaactgtcgcggcccctgctgtaggcttcggtgtagtggtccccgctgtgggcatcgggcgatcggcccctgctgtgggtgtcgtgcgagcggcctcggtactcttcgtagtggcctcctcctccatagcggtggctccggtcgtaactgttgctggaactgtcacggcccccactgtaggcgttgggtgagtggcctccgctgttggcatcgagagagtgacctcggttctcctcgtagcggcctcctcctctgcaggggtcgttccggctggaactgttgtggcccccgctgtaggcattgggtgagcggcctccgctgttggcatcgagcgagcggcctcggtactcctcgtagcggcctcctcctccgtagcggtggctccggctggaactgtcatggcccccactgtaggcgtcaggcaagcggccactgctgttggcatcgagtgagcgacctcctcctccatagtggtcgctctggctggaactgtcgtggccccggctgtaggtgtcaggcgagcggcctccgctgttggcatcaagcgagtggcctcggtactcctcgtagcggccgcctcctccatagcggttgctctggctggaactgtcgtggcccccactgtaggcatcaggcgagcggcctccactgttggcatcgagcaagcggcctcggtactcctcgtagcggcctcctcctccgtagcagttgctctggccagaactgtcgtggcccccactgtaggcatcaggcgagcggcctccactgttggcatcaagggagcggcctcggtactcctcgtagcggcctcctcctccgtagcggtggctccagctggaactgtcgtggcccccgctgtaggcattgggcgagcggcctccactgttggcatcgagggagcggcctcggtactcctcgtagcagcctcctcctccgtagcggttgctctggctggaactgtcgtggcccccactgtaggcgtcggcagagcagcccccactgtgggcgtcatgcgagcggcctcggtactcatagcggccttctcctccatagcggtggctctggccgtaactgttgctggaactgctgtggcccccactgtgggtgtcgggtgaacggcctccgctgttggcatccagagagtggcctcggttctcctcatagtggcctcctactccgtagcggtcgctccagctggaattgtcgtggcccccactgtaggcctcgggcgagcagcctccactgttggcatccagcgagcggccttggtactcctcataacggcctcctcctccgcagcagtcgctccagctggaactgtcatggcccccactgtaggcgtcgtcggaccggcccctgctgtgggcatcagtggagcggcccccgctgcgggcctcgtgtgagcggcctcggtactcctcatagcggccttctcctccatagtggtggctctggccgtaactgttgctggaactgttgcggcccccgctgtgggcgtcgggcgagcggcctctgtactcctcgtagcagccttcttctccgtagcggtcactccggctgtaaccgttactggaactgctgcggcccccactataggctttgggcgagtggtccctgctgtaggcgtctggcaagacgactggcaaggcctcggacgagcggccttcactgcaggcatcgggcgagttgccctggtactcctcgtagcggcatcctcctccataagatggcggtgtcccccacacaggggcagcgccgcatgggcctccgtagctcttgaggggctctcggtaggagcctttgctgggatgatctgtgtactcatggtcgcgacccctgtagccattttggttgccgtcgcctctcaagggacggtagtccgggacactggagtggccataatagcggcggctgtagtctctgagcgcagggacaaaatccccagggtcgcggcacgggggcagtggctcccggacccgcgggcctgagtagccatcttgcccccacacggccggggccttcccaggcattccactgccgccaatgcgagccaggcttgaccggggcacagccctcttgtggggtgggccggcccagcgccgtggctgcaagcctgagtagccatcttgccccgacacagtcggtgccttcccgcgcattccacagccaacgctgtgagccaggctcgacggcgtggccctcttgtggggtgggctggcccagtgccgcggtggcggcccgcgcttcctgggcatcggggccctgtagggccacaggtcgaaataccccgcgtagccgcggccgtcatcaggcctgccctgagaggggggtcgctgtgggctgctgccacccccacgggttctgtgtgagaaccttgagcgactgccgctgccgggggttggcgggacccatcggctgctcttgaatgccggtttgatggtctgggccaccatgatggccttaccatccaggtacttgccgttcatatctctggcggcagccttggcgtctgcagggctttcgaaggtgacgaacgcgaagcccctcgacttgttggtttttcggtctttcatcaggaacaccttgatgatgtggccatacttgccaaactcggctttgagggctttctcgtcggttttgaggttgaggcccccaatgaaaagcttctctgggcgatccgcttccatcatgtctccctgccgaatggtgggtcagaggaagtgggaagtgatgacgcggcagttcagtcgcggccttcgagcgctctcgtggagggcggctcctaccggttgggggggtggatgtctcaagaaggaaaagagtaccttacgtcatagttcttgggaacaccaacgtctatgatacaggtagaggaaatcctaggaatagaaaataagaagtagccagagaggtaggaagagatcccagaagtgtagtcttctaagccagaggaaaataatctttccagacatatggaatggttattgatatggtggttgttggttacattggtggatgtgagagtggatagaaaccaaattgcagtgggttaagaagtccatggtaagtaagaaatttagttgtgttgtgggtttatgtgagtttggctgtaaaagaagaggcagatggagggggttgtgggatcgtgggaggtatttttgtgtttgcttttaaagatcagagataattcttcgttggtattttaaaagacaaatagcatatttggaatttaggtatactgaagcatatcaaatacatctggttaataaacatgcgttctatgaggtttttttctttttttgagacagagtctcgctctgtcactcaggctggagtgcagtggcgtgatctcagctccctgcaacctccgcctcctgggttcaagcgattctcctgcctcagcctcctgagaagctgggattacaggggcccaccatcacatccggctaatttttgtgtttttagtagacacaggatttcgccatgttggccaggctggtctccaactcctgagctcaaaagatctgcctgctttggcctcccaaagtgctggtattacagatgtgagccaccgcgcccagccgtatgagtgtatttctaaatgatgttttttgccttcaaggtattgatggataatattgtatattttaaagtattttaagtagttgcttagattctaagtgattcagcaagtgtgaaaatagttcttttaattaccatagatataggtatatgtttaatactcactattttcttttcagatctttccagaaatcgttttacagaaattccttctgatgtctggttatttgcaccccttgaaacattaaatttatatcataattgcatcaaaaccattcctgaagccattaaaaatctgcagatgttaacataccttaacattaggtaaggaaacaatttaaaaataaattttggtttttattgttgttctaatccttttttagtcgcaaaggaatatgtttgatttggctgtgtagcttaaatttatctcaacagtatcttatttgtgttttttatatgttcacattattttgtaggcttttgtcttgttcttgagagcagagcttagcaaactttaacacacaggaattacccggggatctgttagaatgcagattctaatttcttaggtctgttatggggcctgcatttctaacaggccccttggcaatgctcatgcctacctgctggtccttagacctcagtttgagtagcaaggctttagaccataaatatttcctgaaattatagcaccacgatacagattttatatgcatccttagatatgtgaaacaaacagtgcttgagttattttttctcacttttgtgacttcttgcttctacttcaaggatggttagagtggggtgagaatgttgaaaggtttggaagtggatgacagttcatgtttatacttagtaagtgcttaccatgtgccaggcagtcagtgttccaaacgctttacccatattaccttatctagttttcatgacagcattttgagataggtaccattgttatccctgcattacagatgaggaaattgggttaagctatttgtccaaattcatagatatattcagcaagtggtagagccaagattaaaatcaaagcagtctggctatagagctctcattcatacatagcttttaccctatatatgtaaaagaatgaacactcagtaagtataagaaaaaaactttccctgccaaatcagtaacattgaatgaaaattgatatattgtgacttaattttagaatttttttctttttttattcagttggaagggataatctcctcattaaccaagttacttgtctaaattcccatatagagaagtagtaaatataattaatatacataaatgataatgttcccttctcactgtgatatatcagttcttttgtatgactcccccagtggtgttacctgacagtacaagctattttaactgaaaccactttacaccttaaaatgtgtgagagaagtttcctggctgggtgcggtggctcacgcctgtaatcccagcactttgggaggccaaggcgggtggatcacgaggttaggagatcgagaccatcctggctaacatggtgaaaccctgtctctactaaaattacaaaaaattagccaggcgtggtggtgggcgcctgtagtcccagctactggggaggctgaggcaggagaatgatgtgaacctgggaggcggagcttgcagtgagccgagatcgcgccactgcactccagcctgggtgacagagtaagactctgtctcaaaaaaaaaaaaaaaaaaaaaaagtgtgagggaagtttccttccaaagatatcaatcatttgggttgctcctttctctaagtaggtataaatctccttggcctggcttaggagaggtttgaggaaagtgaggtatttttaagttttgtctttgtttctgtttcattttgttcttttgcggaaaaagtgattcgccaaaaactgaattacacttctctattaacacatatggtaatcttagttttactaaaactttctctgattctatcctgtcacgatctgtaaaagtcaactttgatctttttttacagtcacaaaaatttttgagcaaactatattgaaataacatttgttctagtgactgaattcttctctaaggcatgtagtaaaatagtgacaattaataatttatttgccggtattaagaaaccagattctggtgaaagatgattgtgttaactcaatgaatatgcatttttttttttttttttagacggagtcttgctctgtctcccagggtggagtggcaccatcttggctcactgcaacctccgcctcccaaattcaaatgtttcacctgcctcagcctcccaagtagttggaagtataggcgcctgtcaccaggcccgactaatttttagtagagacagtgtttcaccacgttggccaggctggtctcaaactcctgacctcaaatgatttgcccgcctcggcctctcaaaagtgctgggattacaggcgtgagccattgtgaccggcctgaatatgctttttaagggaagaaaataaattgatttttaagctatttttggcctgaagatgtattagaatgagtttgccattatttcttccatgtatttatttattttggtgaaaatctcttaataaacttgtaaaataatttttcaactcttctctcttcctatatactacccccctttttcagtagaatcctgtagaaagatccttgtgtgccctggtatgaagggacccagactgaccatttttccaaggagcctgcttcatcctgaaagtatgaaggattatgacaggaccctagcacatttgacattccagcagtctggccattattgcttgttgaggggcattgccatttttttgtttgtttgtttgtgccgtgttattaaagccagtctagtatttctggatgtcctttgccagagaaaagatggggaggagggtctttcaagtcccccttgagtaacactggacttttgttgctgtgtatgttacacgaaatgctaggtataggtctataaatgacactttgaaaaacaggaaaaataatagcttatcgcttaccagtgcttgttagtatgtaaatggaatggaaaaatatacattttgttagtggttcctttgggtcagtcagtctgttttggcatataaatttgaccatagtactttgagggcaaagaccccagagccagattgcctgagtttgaatcctgcctctcccatttaacagctgtgtgactttgagcagtttacttaaactctttgtgactatttcttcatctgcaaaatggggatcactgtgagagttaattcacatgacctgctgcaaaatgaggatcactgtgagagttaattcacatgagctgccctgaacatggcctggcaatagtaggcactcagtaaatgttagttattatatttaaatgtatctacagagataagaatgttttatcaactttgagctgagataaaggtgctaataggctgttaaaccttaaaagggaatgggttagggttactacatgtttttgaagatatagtcctattcactcttttataaacttaaacatagtgcatgcacatttatccctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacactttttagactgaaataaatggtaaaaggccattatatgcaattgattgtagaaatacagaataatttaaattaattaccttggacataacattttaggtattaaaggacattgaattctgagagaaacatattcagagcctcgaagctttcagctatttttcatatcttctggttacctccactttacgcagtataccatgcttcatgtttttcttttattttgaatgatgctttcctaataaacaggtatttttaaagttttttttttgtgatagagtctcgctctgttgcccagactggtgtgtagtgacatgatcttggttcactgcaacctccgcctcccaggttcaggctattctcgtgctcagcctcccaagtcgttgggattacagccatgcgccaccacacccaacttatttttgcatttttcgtagagatggggtttcactgtgttgcccaggctggtcttgaactcctggcctcaagtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttccttttagttaaagtctcacttaatgttgtactaaaaaatgaacagagattccagatatgatctaacaagttcataataaaaggtaccattattttgtttgacttgaacactattaatgtttttccagattttataaaggttataatttaagattttatgtctccgtaatttatttgtttttaatttagtttttggccctacgtttttaattacattacatgatgtaatttttagataaatgaaatgtaaaaaataattaggagttttatattaattctagtacagttgtccctctatgggggattggttccaggattcaccccataccaaaatccacgaatgctcaagtctcttatatacaatagtaatatttacatataacctaaatacattctcccatatactttaaatcatttctagattacttataatacctaatacagtgtaaatgctgtgtgagtagttgttacgttgtattatttaaggagtaatgacaagaaaaaaaagttaatatatgttcagtacaggcacaaccatgctttttttttcctgaatatttttgatttgtatttggttgaattcatggatgcagaacccatggatacagaggaccaactgttttttaatttatgtagaaaattctaaaatgtttaacactattattttactaggtactgtaaaattattatgctttaaactcttgaaatcagtaacagtagatgggtagatagcattaggagggctaattgacagttgtaaatcacatattgaattggtggatattccctgtcattggaatattttctcttgatacttttccacatcatgtgataatcaactgcaatgaaattctgtcattagaaacctaggaaatactctctggcttccaatcctttgcagactattttgtagagcacccactggagtgggttcatttcctatgcctgggtttatttctcttgggaaatgacagctatctctcaaatttctatggattttccatatggaaatcataagtatcaaatacctttagaaagaagcaataatgtttaaataacattttcacaaacttctattatccatcgtttgaatagtagtctattctgaacatagcagctaaggtgatcctgtcaaaatataagtcagatcatgtcaatcccatgttcaaaagtttctggatcctgcccacatctctcagaataaaagctaaagtcatatccctccctctattctactctctcccttgcccatttccctctagttacactggattccttgctgttctttgtacctgtcaggtgcgctctgcctgagcgccttcacttttattgttccttctgtctggaatattcctttcttatatattagtatggttcaccttttagctctgacagtactgctcaatatcaccttctctatgagataaagtagtatccctccccactattgcgagcatagccattttcctaccctgttatcttttttaaatagcacttatcaccttctagcatattatataatttactccccttgctagcatgtaaactccatgaggagctatgacagcaggaaattttgttttgccccttgataaatccccagtccctggaacagtacctagcaaatgttaatagtattcaacaaatatttattgttgaatgaagatgccttagatattgtttgaaagaggtatgtaggatatattttcctaatcatctatagcattattatattcttccctacatggttttaatattattttgaaaactgaatgtatgtactattctcctccctccaagctattatcattttcactaaaagttggaaattgggggcagttgcattagaatatgaatttcatttgaagtgtgtctggaatgattactgtctgagaccatgttgtagatttctcttttttttgttgttgatgttattataagaaagaggggagagagcacagttaacttaaactgttcttttttctgttttttttaattatgataataaataaaaacctcaatttgttattatggaaacttgatatcgtttgcctttaaattggggcttggattttaaccacagagatttcctgagagacaccttagataacctgagagatttccaactcagatctcttagaatgtctttgagctatgagatgagtcacaagtgttggggcttgtaacttctcattttgtatccctttggagaaagagatttagttaaatcaatctttatcatagtctgtttcgccagtgcacatttataaatccttgactttcttagcttctgcccagccaagtatctcgagacaactactgtaattgacagattacacaatgtttgagagttgttagtcttttactttacctccacgtgaagagtgctggatcattcttacttctggttttggctggtatgagttggcctttagttgagattttcgagaggttgtagttactaagatataacctcaaatttttgtatgggaagtttctatttactgtactaggtcggcttcatgatgtcgtataaatagaaatctgccagataatccatctttagagcaatgacattagaggataacttttgctagctattaaccatgtgctttaatttaaaaattagaatatatatatataatatatgtatttctcagttagcttgttataattctgttttattgttctccttaggatattagctgcaatgagattcaagtccttccccaacaaatgggaaaattacattcacttagagagctaaatataagaagaaataatcttcatgttttgccagatggtaagatgttcactgtttttactcacatgaataagagagtaactatgtaaaatttaattaattatttttcatttctgaccagaattaggagaccttcccttagtcaagctggatttctcttgtaataaagtgaccgaaattccagtttgttacagaaagctgcatcatttacaagtaataattttggataacaatccattgcaagtaccaccagcacaggtttgtaataaaaatattataatgtttcttctcatttttattcataattttatctgtttatgactggtaaatcaaaaagcacctaaatcaagagccaatttgttgttcaagcactgttgtctaaagtttttctgagcattgccttttgcactttggtaggagttttagcttaggctctaggatagcatttggaaaacccagataataactttctgcttgtgaactgataattctggttgttagttatttacaaaagtgactctgaagtctctctacctatttcccactcaggtatatatctacttgggatttgttgtgggattgattggagtacattcttggcactgagagatggaattataacagaaagaacaaaatacaagtggaaaatattaattatgacttttagtttagtgaggattaaatccatgtggaatcctcttaaatgatagttaaggaataaactatgatataatcccctatggacaaagtatgaaagagaagaaagaggacagtggggaagagatgtcaatagaatttctgaaaatggaaaatagaatagtagaaacaagtacctttacttagattgcccaaaattatttggctgaggagcaagtagcagtgaaatggtactttatgctgtgtgccctggcagagggtttgcagacatccagaagaaaggtcttctttttcttcctacaaaagtacattccactcattctaaaggggttaccttttctaattcaaataaagactggctagagtcctggtggtagcaaccttagcagaatgaagaaagctgaaacttgtgcctgctatgggagaaggcaatcagattcaagttgatttacagcgtcaaacctgggaatggcttgagtattggaggaaacatgtaactctgaatatagggattaagtactgaaaacatgatggtttgtggaatgtctaaggcagtgctgtccagtagaactttctgaatgatggaaatgttttataatcgacactggtccaatactgtaaccacttgtttatgtggctgttgaatgcttggaatatagctagtgcaactaaggaaccaaattttaaattttattttaatttgatttatttaaatttaaattgctgcatgtgactggtagctcccatattaaacaccacggctctaagatttacaccctcagattcttgccctcagccccacagccacagaccattccttacttgcatcagcagaagtccggaatttattctaaggagtaggtagatccttaggttttctccgttagctcagtggccagatgatgactcacttcttgcctcagcagaagactggtgtttactccttagagaagcaccatcccatttgtacttgctgtggtgatgagcatgttctgtatctgcattgtccaatacggtagccatagtggctactgagtacttgaaagtgtatagtgtgacaaaagaactgaatttttattttatttagatttgattaatttacatttaaatacacatgtagaacacaaaaccaaacaccacatgttctcactcataagtgggagttgaacaatgagaacacatggacacagggaggggaatgtcacaaactggggcctgtgggggtgtggggggcaaggggagggagagcattgggacaaatacctaatacatgcggggttgaaaacctagatgatgggttgataggtgcagcaaaccaccatggcacatgtatacctgtgtaacaaacctgcacattttgcacatgtatcccagaacttaaagtaaaataaataaatagacacatgtggctagtggtaccctattggacagtgaagctataaagggattgaaacagagtcaggggctccaggtacagcttatatagcaagagcgagaccgcatactgaaaacagtgaatggttgcatactgaatgttgagacgctccagtttggctcccagaatgcttgcaacctgtcttacatatttcaggcagaattggtggatttcttccttagtaaactgcagcaggagaagagacctatctatatactgaatttttggagtcacctgatgaaatggctagtctgtgtctgatcaccagatagatggaagctcaccatcaggaaacttccccatgcacacagagcttccagtttgttttttattatcccttttggaaattaacagacaggtcggatggtagctcatgcctataatcccagtactttggaactttggtagactgaagtgggaggattgttagaacccagtaggttgaggctgctgtgagccctgatcacaccattgtaccattgtactacagcctagacagcagagtgagactctgtctttaaaaaaaaaaaaaaaaaaaaaaaaaaaggctgggtgcggtggctcacacttgtaattgcagcactttgggaggctgaggcagatggatcgcctgagctcaggagtttgagaccaccctgggcaatatggtgaaaccccgtctctactaaagtacaaaaaattagctgggtgtggtggcacgcgcctgtagtctcagctactggggaggctgaggcacgagaatcgcttgatccttggaggaggaggttgcagtgagccaagatcgtgccactgcactccagcttgggctacagagtgagactctgtctcaaaaaaaaaaaaagaaaaaaaaagaaaaaagaaaatgaacagccagccaagaatcattagacattgcaagagtaatctctaacatgaaagacagagaccaaaacaccaaaggctttcattgaaacgaaagggagcacatttattttttgtgtgtgtgtggatatccagaaatatttgtaaaccatatatctgatgaggggttaatagccaaaatacaaaaaggattcatataactcaatagcaaaaaaaaaaaaaaattgaaaaataggcaaaggacttgaatagacattttttcaaacaagacatacaaatggccaacagctatatgaaaagatattcagcattcctaatcatcagggaaatgtaaatcacaaccacaatgagatatcacttcacacttgttaggatgcctgttatcaaaaagaaaagataaccagtgctggcaaggatatggagaaaagggaaccattgtacactattgatgggaatgtaaaatggtacagccattatggaaaacagtatagtgcttcctcaaaaaattaaaagtagagctaccatataatattacagtcctacctctgggtatacatctgtaagagatagaaaaataaaccaaactattttttctattttaattctcaatacagaatacttcacttctggtcaccaaaatgcgtcagatttcttcccaccaccaagcagttctccagcagacactgactgggtatcctataattcaattcaattctgacactacctggagttaacatcagatcctacaggttaagagctcagtcccacagactgctcacctatacttctgactgaccaactataagttaaggttcccatgaccccctcctcaggttcagttaatttactagagtggttcacagaacttagtgaaacactttacttactattgctaatttattacaaaggatacaaatgaatagccagatggaagagaaggataggacaaggcatatgagaaggggtgctaactgaaggggtggagaggggatgttccctttcctccccatcataagggtcacggctgatacccctataacaaaaaacaagtaaacaagataaaaggataacaactttatttgatcatagttttacgtgacactggagccttcagaataaggacccaaggatatagagaaagttagctgactttatgcttcgattcaattcagactgggacagcagtgtagaaatgtgattggacaaaaaaagcatgagctaatggtaatagatggagtgggaaaacctagcaaggccttttcttggtgtctctgttgtagcgtttgttccttctgggtgtagggtaatacttctctggaatgagggttttaatttgtttatggccagtggttacacagaaaggtaggggaaggttagattaggctttatggctggctttggaaaaaaggggttctagtgcctatgactggccttggggacgataaattcttgtttccatgacttgcctctagtgagaatgaggaggtgagagacaggggaggggcgtctggagaaggtcagagaaaaactttgcttctgaggctttcattttggggtatcattttctgaacctcaatgaagcttttgtgccctctgtgggcacgccaccttccaggcacctccacgtgtttagcaatttgtaagctttccgaaccctgtccttttggtttttatggaggcttcgttgtggaggcacaattggttacatcattggccattggtgatcacctcaactttcagcccttctctggttcctggaggtgagggaggtaggattgaaagtttcaaccgcctaatcccatggttggttttcctggcaatcagtcccttatcctgtggctatccaggagctcccagccaccagtcattcattagcatgcaaagggatacttaccacttaagagatcgtgtaagagttttaggagctgtgtataggaaatgggagcaaaaccaagtatacattccttacaaattacaatatccgaaggaaatgaaatcaccatcttaaagaaataatctgcactcccatgttcattgcaacattattcactacagtcaagatatggaaacaacctgtatgtccatcaacagatgaatggataaagaaaatatagtgtgtgtgtgtgtgtgggggggggggtgtgtttgtgtgtaatgaaatattattcagccttagaaaaagaaggaaatcctgtcatttgcaacaacatggatgaaacttaaggacattatactaattgaaataagcctgacacagaaagataaatgctgtgtgatctcacgtatatgtggaaccttaaaaaaaaaaagttgaactcctggtgacagagagtagaatggtggttaccaggggctggggggtgtggataaaggggagattttaaacggtaccatccttcagttataagatgaataagtactgaggacctaatgtatatcatgctgataatagttaataatattgtatttacttgaaatttgttaagagagttgaactgaagtgttctcactacacacacaaacaaggtaactacatgaggtgatgggcatgttaattagcttgactgtggtaatcatttcacaatgtataatacagttgatccttgaacaacatgagggttaggggcatcgaaccctgcatactgtaaaaaatccatgtataactttggaatcacaaaaaacttagctgctaatagcctactgttgactggaagccttatcaataacaaacagttgactaacacatattttatatgttatatgttatttactgtattcttacaatcaagtaagctacagaaaagaaaatgttattaagaaaatcataaggaagagaaaatatatttaccattcactaagtggaagttgatcatcataaagatcttcatccccatggtcttcacattgaacagggctgaagaggaggaagaggaggggttggtctagctgtctcaggagtggcagaggtggaagaaaatccatgtataatggacctgcacagttcaaacttgtgttgttcaagggtcaactgtatatcaaagcatcacgttgtacaccttaaatttgggagttcagtcagggtggtgggaaaaattatagaagaaaagttatgaagatagttataggaaatagacacaaaccttcttggaaggctgggggggttgcatagcttcagtaaaaagttcagctgaagtcagcctaatcctcttaccttgagttaatagtttaaagtaggtacaaaggaatgtaagggagtttatctaaatagcttgtttactcatgtggccctaagcccaaccttttatcatctgtgagtgcatgattgctctctactcgaggggttggcagtgttaattaccttctagcggtgtttactcgagacctttgtaatttaatcagtactaaataaatgcgaacttccccggcttatcgaggcagatgctgcagactcaggcagcagagccccttagccagactgacaggcaaagtatctgtgtcagtgtacgtctttcatccgtcattgggtcagggtcagcgggatggacatggcacttaaatataaaaaaattttatttgtaactcatactttaataaagctcgaagaaaaaataaagaggaaaaatggagcatattcataggagtgctaatcagcatggctttctagcagcagttgtggaaactggcagatgttggaatgataccttcgaggactaagggagtatttctaacattctacattcaaactgtcatcaaatgtgaggtagaaaaaggtttcaaacatgcaagatcttagaaatttttactcccatgtaccctttcttaggatgctagcagagggtgtactataccaaagtgagggagtaaactaaaaaaaggggaattcttcttgtctgagattgacagatatgcataggcctagtaagcagccagtcagtagtttggagtacaggagttgtctccaaaaaaaaaaaaaaaaaaatagaaagtaagagatgatttgatacgtttgtccacatggagagatgttttatacttctgtcagagtcaagaatgaatttataataggcatatagaaaatttttcaaaagaaaaaatggggccattaattactttaggaaaaacaaaaacttacaggagaaaggaaatgtaatcatattactctgtagagtttatctgtgaatattttcttggtcataataatataaacactagattttgatttagtgaaaaactgtgacatagttataatagcagagatttatatagtatttgctgtgttctagacactgttgaaaatgctttacatatattaactcatttaattcttatgttaaccctgtaaaacaagtactgtcattatcctcattttacatgtaagaaaacagaggcatagaagttaaatgacttgttcaaggtcacattgctagcatgggttagagccaggattcaacctaaggcagtgtgactgcagagtccatgctctttaaccactatgttatacttctgaagagagaagtatgtttatgtgaattgataggaagcggggaggctgggatggtggtggtggtgtgggtaatgtaagaaatccaagtcctcatcttccttagtgatactccaataaatctaccattggaaaatttaaaacaaatagcagtagaagcatgttattaataaatatgagggcaaatagaaattaaactaaaagagtttaaagtgggaatttgatcttagagattgaaataattagaatgggctgggcacggtggttcatgcctgtaatcccagcactttgtgaggccgaggtgggaggatcacttgaacccaggagttcgagaacagcctgggcaacatggtgggaccctgtctctgcaaaatataagaaagattagccgggcatggtggtgtgtgcctgtaatttcatcccagctaatctgggaggatcacttgagcccaggatgtcgagggtgcagtgagccatgtttgtgccactgcactccagcctgggcgacagaatgagacgctgttttccaaaaacaagcaaaaaaaaaacaaaaaaacaaaaaaaaggagaagtagaattgaggattatgtcttgtcagctttgtaattatttttaaatttaaaaactgtgtacatgaagtactatgataaaaagttaaaatttacaagagagtgatttaccagcacttaatttggtaattaagataaatttttgtttagtttggacgtataatagaatactacctcacattttaattttagcacattttagttgatagtatttaatattaataatttataattaatagaaaaatcaatgatatttacaacatttaattggcaatatatttatattctaatagctcaaaagttttaattttccttttaaatgaaatttttcagtggtcaagtcagacctagtatctgttagaattatctaagaaacattcttcctttggacctggaatgataattgctttttaatgttgttgtcttactgttttctttgctgatttttttgcatgtgaggtaagcttatgtgagcccataaaatgttacattttttattagaattttgagaaatatttatttgatgtcacttagtgactgtaattaaccttgataaagctgacttacagttttcttacctctcattttctattgtttttatacagagtatctttgctcacatagtattttattcctcattattcattttctctatggccaacgaaagtaatttcttaggatattattctagttgaattgaccagtgttttcttttattatttcagtctcaccagcctaatatcgtacctttcaaaaaattcatttttcctatatttatattttttatgttagccttctccaggttttatgccaaacatcttagtggttctgatgagattactttaaagaatcacatagattatttgttcttttcttaccattccaatgaatatatatttttcattttttcaaataaaggccacttttatgagttgtaaacttcatattgtttaatagtttgtacattctgcttttgacaagaaaactctagtgaaatatagaaaaattaacttttttcaataagaacagagatggcaatagaattttagttggtatcagtgttgtcagatttttccacctggtgtcagaagtacaaattatttaaatatgcaaagtatcaatcaagattgtgatgtctcaatgtaatttgagactattgaatggtttaaaatgatagatgtcatttatatttggaactatataattaaatctttattttttattgacagatatgtttaaagggtaaggtgcacatatttaagtacttaaatattcaagcatgttgcagaatggataagaaaccagattccctggatcttccatcattgagtaaacgaatgccctcacagcctctcacagacaggtaatgtaacattcttacagtttcatttgatgattgctgtcttctctttttatgaaatatacttattaatcttgagtgttccgaatatatttaggctgattggtccagcactaaaataaataattggctgaagctacatatcaccatcatagaatgaagttctaggatactagaatatttttgacattttctcaatcattaaagttttagtagtaaaaatgtaaatgtttgacattatattacggaaacactaatttctcagcatgtgacaactgttaatttattttgtgatcactgtattgtacatttgtaacaacaagtagaatttgactttgaactgaggttggtggaagagcaagacatttggggagtaccttttccctttcatcatagtctttatgtctggatcaaagatgatatatcataatgacatataatgatatatcatctttgatgaacatctttgatgttctttatgatttcagtgttttgatcctcatgagattttgagatagtagattgaacattctgtttttaattcatcctttcaagatgtagattggtctgaaagattttatgaaagtataaatccatgtaatagtttagaaaataacctagaatggggtgagactacagaaagctagaccatgcccttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaaaaatataatgtgagccacatatataatttttaattttttgttacccattttgaaaaaagtaaaaagaaatacatgttatttgagtatatccaaaatattatcatttcaacatgtaattaatgtgaaaacttggtgagatattttatatgcttatttaatattaaatctttgaaatctggtatgtactttatgtgtatagtgtgtctcgatttggaatggctgtatatggctactggctgcttaccgtattggacagtgcaggtctatagagtgggttgtcagttgtattaatttctcactcacagcctgtattgaactacttagaaaattcttgtatgtgctttccactttcatactcaggctcttggctgtatggttcttactacctagaatgcccttccatgccttgtctgttttgtaaactctttattatacatagataggcactacagtacttacatataatagcttttggagtcagacataatatggctttgaagcccttttatgactcttaataactgtatgtccttgtgtattaatgtctctggtcctcagttttctcatatgtaaaaaagaaaataattacacaggtgctgtcaggattaaatgaagcaatgtatgtagagcacttagtgcaatgccttacccataacatttcctcaacaaatagcttattatcatcattgtcatttactacaaatacatggagtattttgtgcagtgcagtcagatgaattttggctctaatcatggtttaactacttaatttctctgtggccttgtgtaagttatttaacttctctgagcctgtttccatacctaaaatgttaaccatacccacttctacagttgtgagaattaaatgtgtgcctagcaattagttcaataaatgataaacagcaaatgttataatttttccccttgggacgttaacttttgtaagctttatttttttttgtaaaaagataataattataacttcaagactgtaagaattatgtctaaaatatgaggtgcatctaacacagtacataacacagtatagacactcaatgaatgctaacagttattgcctcttcatccacaagactaagctcaaatgccacattcttgagtgatgcctttcctaactttaccgaggagaattagttgaccttttttttttttctcatagcactttgtatttacctttgtcatagtcttcaaaacatttaaacacattcatttttcctctaggctgagagctagctctttggaggcaagttttaaaaatgtattttctcttaagcattcagcatagtacctgatacttggtaggtgattccctaaatgtattcatatacttctgaaaagtacaaaaaaaagtttttttttgttgttgttattgttttttttttttttttttttttttttttagcatgaaactggttttaggagcggaattaaaacatagtgattaccaccagggactttggtgctagataattgagggatcaaatttggactgctggctgcaagttgcgtatccttggataaattgcttaatccattccagtcaaagttttatcatatataaaatgagaaaacaccatcaatttgctacagtttttcacaataaatatgtaatgttttgtcttttaaacatttagcacagttcctcatacataataagtggtcattgtagactgtgtggtaaaattgcaaattaagtgaaaaatactttgcttcctgggtggcatattttgtaaatcagaaatttgcaaggacaaagtgaatttgaaagtattaaagtgcatattcaatactttgtagctttcatttttacatcctctctttattagatgggcattatttatataaataaaacatttttagagccaatgaagagtaaagcatataaattgaagttaaaagatgtttcgaagctctgtgatgaaatttgacaaaccaatgggaaaaacaggtcttccatcaagataatgttctaacaaggcagcctgattttctgaatctctgaggagaaataataggttattgttgacaattgacactatagagtacacgaagggaacaatattgcatgagtggcatgaataaaatgttttgtaggaagagttctgatatttttctcctcatgtccctaattaaggatcttagacatcaaaagtatatattctgtattatctagggaaattttaggtcaaatgtgcattatctatttaagaagaaaatcctaactgctcttaggatttctatttccatagtatggaagatttttatccaaataaaaatcatggccctgactctggaattggaagtgataatggagagaaacgattatccacaacagaagtgagtattttctattgctgatccattctgttttacaattttattagagcattgaaatagagacccttgtgcatacttgagtttattttgcttgaaaatatgatcattatattttatgactaaaactgaaaaaaagggcatgctgatttttaaagctgagcagtaaaccttatgttaattttgggtttgaaaactggagatgtaaagcagacattctgtaattcatatgtaaaattgaagtaacataatccatatcgtaagtttaaaatgcctcatttgtactttttgcttattccttttagccatcagatgatgacacagtcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatcttataaaatgatgaaatatgacctaccacatttttttcagttactccttcaggttgctttatagatgcagaaaggaaagaagaaacatttggtgaatacctaccatataccaggattagtgctatgtgctttcccatgtttctcattttatcttcattaaaatcctgtagggtagatactgacctcattttttcaggtgaggaaggtgaagttcaaagactcttaagttttatgcctaaaaccacttagccagtgtccactagtacctagagtgtgaaagtagctctctttgatttttaaacttttctcttttctctacattatgcttcctccaaatgacttcacagttattagttaatcatctctgatgtcctgtaaggaggtacattgctttgtcttgaactgtttagatttcattcttttactttctcacctcatctaatgaggtcagttgcttaaacttgagaaacacctgtagcatgtacgatgtggtaaagtcacaaagattcatggtttgatactgtttttaaagtgaaatctaaagataaaatgactagagtttggataactattttaaaatttttttgttctcttttataaagatgacatattagtattttcacgcaaatttgccaatcttatttgaacctattttggattttctttatttagacatatacagatttttaaaatcaaaatcaataaactgataaaaacaggatggtgcaattaaatgacaaaattttacaatattttaaatttatgtattaagacaggccatatagaactctgcagtcctttttatactgaaggctggagaatatacatttttagattactattaaccattacacatttcagaaatctaaaaaatggtttatatactttgctattatttgttagtcattaattatattaatacagccagtatgctacatttcataatgagtagagaacacagaagttttccttatttcttattttagcattttaaaagaaggacctaggattttaactttcatatggtgttaaaaacaaaaatggtttctatttctggaagctggcataaaatgtagtctgccttactttttggataaccatgtttgtgtcacctttcagacttgagaaagaacagttactggcagaggaagaggatgatgatttgaaggaagtaactgatttgaggaaaatagctgctcagttattgcagcaagaacagaagaacaggtattcctttcagtaatgagatttgaattggcaaattttataatcattaaattgattatttaaagattatcaaagtatatgaagttttgagtaaacaatagtgccctcttaagatctatctcaagggactaactacagattgagtattcctcattcaaaaatctgaaatcggatcccaagcatttcaaataagggatactcaacctgtactaaaaggcaataggaaatacttaggacgggaatataaaattacatttacaactaacagaatgtactcatatatatagtcactatatttaatattgcctaggtatttcttttttattcctgtgtgtgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagacatgtccacttctaatgcaggaaaagttccatatgctgctgagggtcagctgttattgccatcttcatgtactgagaggactacatttatagttttgaaatgataaagatctgaatggtttttttttgctttgagaaaagagaataattttggtgcatttaacatggataagtaaaatattttatttcatttattcaaaataataaatgtttatggttaatatgaccatgttttgggaagtttcaaatttaaatatactggcatttgtttaaatgtacattgaaaaatacaactaaaacttatcaaatgacaaatatatggtttctaggggccactttttaggggcaatctatataatagctaataagctaaattgcctaagtgtcttttttgcacagttgctacatttatagatatacaaaatcatactagaaaatcactaacctttattcctttcatatcaaatgtatcttcatcagcagttcacatttttcttctgctgtaactttcggtctgctttttctgtgatgtttatcttttcaacttttcctgtgattcttttctaatgggccttttaaaaattggctacttatgaggctgtgtttgtttttccccctccaatataatttaagtgttgattgccctgtgatttaaaaggtttgatgaagcaagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtcttggctcactgcagcctctgcctcctgggttcaagtcattctcatccctcggcctcccaagtagctgggattaccagtgtgtgccaccacacccggctattttttttgtattttagtagagacggggtttcgccatgttggctaggctggtctgaaactcctggcctcaggggttccacccgcctcggccttccaaagtgctgggattacaggcgtgagccaccacgcccggccaaagagcacattttacttttaaaatttataacgtatggagaattttagatccctagccaattctgttaatgcctgaacttaaactggatctcagaatttttaaatgctaaatctaatattttttctattaaataatctttcttccttctacaatatgttactattgcttagatcttttagatttagggacttaaaatttttagtttactgtcacaatacttgaatttgaatgagaccaaaaatctaagcgtaatcctatatgagaatatatcctacagtggatttgatataatttataccttctctggttgtggattttccttttcatgctgtattattgtgtcttatattccaaatatattagtgaaggatctgaaatgctatttaaaattgtaggccaggagttgtaacatctctttttaggttttaaaataattattgtaaattttgtttgtttttagtcttgattaaaaataatttaactggattaagattaccctcgcctaccaggaaatatcatccaggactgctactttgactgtatattacttaactgttctttaacttgctactagtagaagacaaatgcaatgttagctctcagctaaatgaagccatgtatcttctcccaaactagaggtaattaaaaaacagcttacattgagttcagtgatgatttccttatggcagttttgccacttgcttagttcatatatatttttaattttttaatttatttttttttaatattttttgagacggagtctcactctgttgcccaggctggagtgcagtggtgcaatctcagctcaccacaacctccacctcccgggttcaagcaattctcctggctcagcctcccaagtagctgggactacaggcatgcgctagcatgcctggctaatttttgtatttttagtagagacagggtttcactgtgttggccaggctggtcttgaactgctgacctcgtgatctgcccgcctcagcctcccaaagtgctgggattacaggtgtgagccaccacgcctggcagttcatattattttttaaaatgtctttgattctttaagaaactttatgccagtacttggtacatgaaactatcctaggggagcagcaagaggatattgtacagaattaatactcaaaaagggtgagaaaagagatcagcaaataaaccatcaaattggtaactcataaggttttaaagtctgaagcctagttgtttagaagactgcctccactttgtctgattaagatgtgtaggttaagctactttatgtttacagtttattgttgaattttttttttttttttttgagacagtctcactctgtcgtccaggctggagtgcagtggcgtgatctcggttcactgcaagctccgcctcctgggttcacgccattctcctgcctcagcctcctgagtagctgggactacaggcgcctgccaccacgcccgactaattgtttgtatttttagtagagacggggtttcaccatgttagccaggatggtctcaatctcctgacgtcgtgatccgcctgccttggcctcccaaagtgctgggattacaggcgtgagccaccgcgccgggcctgaatttttttttttaattgataaacagtctttatcatcccctgtcaaaatattggattattatttctacttgcatctgagtgtattgaagtcactctgaatcaatgactttgactatatttaaatagctattcatcaagttctaattttaccttcactattattttgggaaataaaaacaagtcttgaaaaaaaatcattatcttaaaaataatgttgcatgatgagtaagttctagggatctgctgtacaacattgtgcctataattaacagtacagtattgtatacttaaaaatttgttaaaagagtagatctcttgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatctagatgtttaattagaatagatgtttgttttgacttttggtatcagagtaaatcataaaataatgaacatagcaaaattttacataggtgaattctcaagtacataaaatatattgtataggtaagtggatctcaacttgtttttctgtttcaatataactcatacacaaccgtaatcacaatgctaatgaatgtgtggtgagaaggagttagaatttactatagtgaaggccattgtagtttgagtcccctcccctgcaataattctgaaatttcccccagggtagtacttactgcggtctcttctttaaaaaaaaatcactcttttaaaatatatttttcctaatagttttagatatttcattaccttaatttttctgtatttaagaatttaaggcaattttaatgcatgcctatacaaagaagaagtgtccttaattctgaaattgtttggcccaaagctacactgattggtgtgtgatacttgtcctttgcatctcattatcactttttcctagtgaggccctactagatccacgctagtgaggaatccagcgtaatggactttggtttctttatgctaaccatatttctgtaattaccaacttatatttaattcattatgtattttattagtcaatatatagcttttatttaaaatccatttctgtattcttttggcagttgacgtctggagattttattttgaataaaaggccgagattttacttatattaaattttaaaagtgaaaattatatttatatatagtaacattaagaactcttaagtatagttccttatgttaaggacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcctgagtcaatcctctgagaatgttcaggcccagtctttttctgcttggcttattccagcagtcccaagacatagctcctttttttcaggtttgcctagctttaagtctgtcttctgcacaatggaagagtgataattctgaaacaaatcttacttgtgactcccatttattatcttctaatgactctttacaacttttagaataaaccttaaaatatttaacttaacccataagattgaggtgggtttctgcttaccctgagagcttcatcttgtacattcccccactggcaccatttgcatttaggaacagaacttctttcttcattctcttggggaagttatttagcttactctgagccacatttaccccttctataaaacacaaataataacagtgtctacctcatggttactgtaaggatgaaatgggttaatgtagtaaattgcttatgacggtgattagcacacagaaagtgtcacatatgttattagttgttaaactaagttattactattgtgaactttcttatttttcctttcttttgtatctcagcccttcctttttcaattctaacctccttttttgttcaaaagggaaatagctttgtgggtattctttttctggtattaagaagtattatatgaccttaacttttttttctttttttaaattatactttaagttctgagatacatgtgtagaatcggcaggtttgttactaggtatacatgtgctctgatggtttgctgcacgtatcaaaacacattaaattatgggaatatattttaaattctgtgacttttttcagcagtacgtgggtgagcacaccccaccccttccccacctttagaaaaatctcacatactttctgttaacaaaaatgagatcatactgagtatactatttagtaatatgcagttttcacttaatattatagtgatggttttatatacctactaaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacatttttttttttttttttttgtagagacagggtctcactatgttgcccaggctggttttgaactctcggtctcaaggaatcctccttccttggcctcccaacgtgttgggattacaggcatgagctaccatgcctagctcaccttcgtttttgaaagatattttggctcatacacaattctagtttgacattttagttttcttcgagtaccttgaagaggtttctccaccatcctctggattgtactgttttctatgagaatattcttatctttgttttactttgcctaatgtgtccttttttcctctgggtgtctgtaacattttttatcactcgttttaagtaatttgatggtgatatatcttggtgtagttttcttcatgttacttttgtttggagttcattgagcttcttgaatttgtgggtttattttcatgaaatttgaaattttggggcccttatttcttcagatatgttttctatcatttgacctcttctattatggaactccaattaggccacttgaagtttgccatggaacattgatgttctattcattctttaatatttttctgtctgtgttgggttttggcaagtccttctgctttgtctttgtgtttgctagtcatttcttgtgaaatgtctaatctgcagttaattccatccagtttgttttaatttcagatgttgcactttttatttctagaagtttgattatgtctgtacttaacatgttcagtcttttcctttagcttcttgaacattgcttggttgaatttttgattaaatgacagacattgtgtactttacattcttgagtgtggatattgtattattatacatacttttgacttttgttctgggatatggttaaattacttggaaataatttgatattttgggacttggttttataatttatttatgtgggaccagtgcagcatttagtctaggaataaatttgtccccttaatgaggcaagacatttctctactggatgtcctgtgaattatgaggttttccagtttagctggtgggaactggtactactcctggtcctctgagaatctgggaattattccctctaagctttgagggtgattttatccttttgcctagggtattttcctcacatacatgttcaatgatcagtacgctcagatgaaaatttgagggatgcctctgtagatctctttcctttctctgtgcattgcccttttgtttgttactgtgtgctatgaactcactctgcccttttctccctggctccagctctgtctcctgaattctgggcctgctagactctgccttagtttttttctcctgggatgtggactggaaactctttccatgcagcaacttggctcagttatgggatttacctccttactcatctctaaaggataatgtcattttttgcctaatattcaatgtcatggaaggcataattttaaatattttgcccattcttttagttttttcagtcaggatataaatctggtcactgttagcctatcttggccactagcaaagtctagtttttacattttatgtgttcaaatttgttagtatttaattttgattgtttgtcccataggctctctctattccaatatttaaaaaattactgcctgtatttttctgatactttgtgatttcttctttatatttaaatcttttaatttttcattttgatatttggtatgaggtaaggaatctagttttcttcctcccccacctttttctcactgtgtctcctcccccttttttattctttctttcagtgtatattttacacgtgatcaatcaggtgtctctctactacttgttatataagccattactttcacaatgatcttaaatgtcatttttttcagaagttattatactcgtggtcctgtactcctcttccattgaaaaatctgtagattctggagctagtagaaaggagggttgaaaagtcctctttattatataacttttctcttcgtgatcatccattcttccaaattaactttggaactcctttgtcaaatgtttaaaacaaaccaaaaaatacttcttgagttaaaaaaattattattacagttcatttcagttattaattaagttgaaagagaagttatacctgtaatacttatctatccaagaaccttttggttattcaagtctcttactagacatttgtagttttttcatgtaggtcttgtagaagtatagttaagtttcttcctaggtattttatacttttctttccttctatgaatagcatttttttctaatatatcttttaactcattatagttgatatgtaggaaagctattaacttttgtatgtttttctttaactggtaaccttacctcttataataatagattttttgtctttttctcttggataatcatgtgttctataaattttaaaaattggatctttatatccaatttttattttctttttgttattgcactatacagaaattccacaatagtgttaagttatagcagcttcagtggacattttgtttatatattttttccacaggaactccttgttcaaaattgccatctaacaacagcatgcatagtctgccttatctcaacaacaaaaaattagatgaaaataatttccttcatagcccctgttttgttagaatgaacaggttgcatctcataatcagtaattcagtaggcaaaaataactactcgcttgagctctttggcatttagacaaaggaaattattagttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttcatataataaaagaaatttaatatttatttgctctcctttattgtagtataacaatacaaattcttagtatactaccaatatcgtagtataacaaaaccagttctcctttatcatagtaacaataccaattctgactatttgtcaaaaaacttacatagcacttattaagtgccaggcactgtcctaagacttcacaaagatcaactcatttaatcctcataacaaccttatgaggtaagtacaattatgactatttctgttttacagatgatgaaattaaggcacagagatgcaaagtagtattcttcagttcacttagtaataagtggcagagttgagatttgaacccaaagcctatgctaggctgcctctttatctactgtgtatagcttaatatcatatcagcaaacactttcaaacaaacacagttttactggtttttaatttttttttttaagagacagagtctctctctattgcccagactgcagtgcaatagcgtgatcatagcacacagcagcctcaaatgcctgggctcaggccatcctctgggctcacgtgatcctcttgcttcagcctccccagtagctagaactacaggtatgtcccccagtgccctacaaattttaaaattttttgtagaggtgagatcttattatgttgcccaggctggtctcaaattcctggcttcaagagatcctcccatctaggcccccccaaagtgctgagattactgacatttttggcccacttttagtgtttaaaaaacgttttacagtaacttgagtggacttctcaagatgtcttaatagaggccacattttaaaaatgtgcattttaaaaactgagcattttaaaaacataattctttggtttcatagcatcatttattggtattttattttttataaaataaacatcttctataatattagttatgttataaagttattaaaagagatcaaatgatataatatttgaagtgctcattacataatcatcattcaacaaatgttaatttttttccttaataaattaggtgcaaagataagcttcagtcactgggaaatgttttaaggagatgtgtagttctcctaaattgtcagaagatgtcagtattaggacatagtaaaatgagtatgtcactagttttttttcctaagatgtcaagaaaatataaaactgacatacagtttcctaaattaaatcaacactattattcagaattgtcactattttcatgactaaaacatcagcagcttctaagaggaaatttctcttaatcacctatctcccgataattgaaagtgctattggtaggttgtattattaaagctaatctggatttatagttcattaaacagtaaaatacactacacttgaggtttatatcagattatcactgagtttgttcaatggtggctcttttaggttttgctatgttacgaaatgtacagaacttttgtgcaactttatcttaatacgtataaatgactgaggcacaggatttctttgtttctgtcccatggtaaattatttgtcatggttattcagtgtatttattgaatgtgtgtgtgtgtgtgtgtgtgtgtgtgtgtgtgtgtgtgtgtgtgtgtgtgtatgtatgtaagaaatccaactgtatttcttcttagttttgaaggctaattttggatagtatttttttcaggtaagtccctgaaactaggtaaaactgtttcaacatattggctagattatgtgagcaagaacacaaattgggtcaggttaagttagtaagtaaatcatggtaggaaagttacattgactcttttagattcccaggccgctatcgtatagattattattctagtatataaaatttagtgttcttatagccaaaataaaatcactgtatttcagggaacttcatgatgccaggaagtattttattaaacatctttttttattttaaatttttaatttttggcgttcatattaggtatatatatttatgggatacatgagatattttgaaaggcatacaatgttcaataatcacattatggggaatggggtatctattccttcaaacatttatcatttgtgttatgatcaaattatactcttagttattttgagatgtacaattaaattattattgactatagtcaccccattgcgctatcaaatactaggtcttatttattctattttttatgcccattatccatcttcacctaccctctactcccccactacccttctctagcctctggtaaccatccttctactctctatctttatgagttcaattgtttttacatcctacaaataagtgagaacatgtggtgtttgtctttctgtgcctggcttatttcacttaccataatgacctgcatttcaatccatgttgcaaatgacagactctccttctttatggctgaatagtactccattgtgtatgtgtaccacattttctttatctgttcttctattgatggacacttaggttgcttccaaatcttggctattgtgaatagttttgcaataaatatggaagtgcagatatctctttgatatactgatttcctttctttgggttatatacccagcagtaggattgctggattgtatggtagctgtatttttagttttttgaggagcctccaaactgttctccatattgttcgtactaatttacattcccaccaacagtgtacgagggttcccttttctccacatcctcaccagtatgttattgcctgtcttttggatataagccactttaactggggtaagatgatacatcattgtagttttgatttgcatttctctgatgatcaatgatgttgagcaccttttcgtatgccagtttgccatctgtatgtcttcttttcagaaatgtctattcacatcttttacccatgttttaatctaactattagatactttcctaaagagtcgcttgagctccttaaattctggttattaattccttgtcatatgggtagtttgcagatatttcctcctattccgtgggttgtctcttcactttcttgtttcctttgctgtgcagaagctttttaacttgatgtgatcccatttctccatgtttgctttggttgcctgcgcttatggggtagctcaggaaatttttgcccagacctgtgtcctggagattttcccccatgttttcttatagcagttttatagattgaagtcttagatttaagtccttaatccattttgatttgatttttgtgtacaacaagagataggggcctagtttcattcttctgcatacggatatccagttttcccagcctcatttactgaagagactgtcttttcccccgtgtatgttcttggcagctttgttgaaattgagttcactgtaggtgtgtgaagttgtttctgggttctctgttctgttccattggtctgtgtgtctgtttttatgcaagtaccatgatgttttggttaccataggtctgtagtataatttgaagtcatgtaatgtgattcctccagttttgttccttattcccaggatagctttggccattcttggtcttttgtggtttcatctaaatcttaggcttgatttttctatttctgtgatgaatgccattggtattttgatagggattgcattgaatctatagattgctctgagtagtatggacattttaacaatattgtttcttccaatccatgaatgtggaatatctttccatatttgtgtgtcctcttcaatttcttccagcagtattttatagttttcattgtagagatcttttacttctttggttaatttctaggtgtttaattttgtttgtgagtattgtaaatgggattatttttaaaatttcttttttagattgttcactgttggcatatagaaatcctactgacttttgtatgttgattttgtatcctgcaactttacagaatttatcagttctatttttttttttttggtggagtctaggtttttccaaatacaagattatatcatctgcagacaaggataatttgacttcttcttttccaatttggatgccctttatttctttctcttgtctgattgctctaggtgggactcctagtattgtgttgaataacagtggtgacaatgtgcatccctgtcatcttttagatcttaggggaaaggctatgagttttggcttttattatgttgagatatatttcttctataccccagtttttgagagtgtattagtctatttttatgctgctgataaagacatacctgagactggtcaatttacaaaagaaagaggtttattggactgacagttccacatggctgaggaggcctcacaatcatggtggaaggtgaaaggcacgtcttacatggtggcagacaagagaagagagcttgtgcagggaaactcctgtttttcaaatcatcaggtctcatgagacttattcactatcatgagaacaacacgggaaaaacctgcccccatgatttagttacctcccactggtatctcccatgacacttgtgaatcgtgtgagttacaattcaagatgaggttttggtggggacacaagcaaaccatatcagagggtttttatcatgaaggaatgttggattttagcaaatgcttgtccggcatcaattggaatggtcatatgatttttgtcctttattctgttgttatgatgtatcacaacaattgatttgcatatgttgaaccatgcttgcatccctggaataaatcccacttggtcatgatgaatgaccttttaaatatattgttgaattcggtttgctagtattctattgaagatttttgcatccatatttatccgagattttggcctgtagttttctattttggatgtgtctttgtctggttttagtattaggctaatactggccttgtagaatcagtttgccagtattccctcctcttcaattttttgaatactttgagtaggattggtattaggttttctttaagtttttggtagaattcagcagtgaagccctcaggtcccaggcatttctttcctgggagactatttattacagatttgatctcattacttgttattggcctgttcacattttggatttcttcatgatccaattttggtaggttttatgtgtctaggaatttgtccatctcctctagagtttccaatttatcggcacatagttgttcatagtagctagtagtggcccttcgaatttctgtggtatcagttgtaatgtctcctttttcatctctgattttatttgggtcttctcccctttttatcttaatctgactaaaggtttgtcaattttgtttatcttctcagtaaaccatatttttgtttcattgatcttttttatttttcttcatttcaaatttatttatttctgctctgatctttattatttcttttgtttttgtttgtttgtttgtttgtttaaaccagagtctcactctttctcccaggctgaggtgcagtggtgtcatggctcactgcagccttgacctcccagggtcaagccatcctttcacctttcagccttccaagtagctgggactacaggcaccaccacacccagctaatttttgtattttttgtagagatggggttttgccatgttgcccaggctggtcttgagctccttggctcaagcgatctgcccacctcacgctcccaaagtgttgggattacaggtgtgagccatgacacctgggctgtttcttttcttatactaactttggatttggtttgctcttccttttctggttctttaagatgaatcattatgttatttgtttgaggtttttcttctcttttgatgtaagcacttatagctggaaattttcctgttaatactgtttttgctgtatcccataggttttgctatgttgtatttgtattatcatttgtttcaagaaatttttcgatttccttcttaatttcttcattgacccactggtcattcaggagcatattgtttaatttccatttgtttgtatagttttaaaaattcttcttcttattgatttctggttttatttcattgtggtcagagaagttgcttcatgttatctcagcaacttctttgttgtttgactgttttaagacttattttgtgacctaacatatggtctatccttgagaatgatccatgtgctgaggagaagaacatatattctgtagccactggatgaaatgttcagtaaatatctgttgggtccatttggtctatagtgcagattaagtccaattgttctttgatgattttctgtctgggagatctgtccagtgctgaaagtggggtgttgaagtctccagctattactgtattgagatctatctctcttgagctccaataatatttgctttatatatctgagtgccccagtattgggtgcatatatacttacaaatcactatatcctctgactaagtttacccctttttcattatataatgaccttctttgtctcttgttcatttttatcttgaaatccattttgtctgatataagtatagctacacctgctcttttttggtttccattggcatggaatatctttcttcatccctttattctcagtctatgtgtatcttcgtaagtgaactgtgtttctttttttttcttttttctttttctttctttcttttttttttttttggtggagtcttcctctgtcacccaggctggagtgaaatggcatgatctcggctcactgcagcctctgtctcttgggttcaagcaattttcctgcctcagcctcctgagtagctgggactacaggcatgtaccaccatgcccagctaattttttattttttgtatttttagtagagatggggtttcaccatgttggccaggctggtcttgaactcctgacctcaagtgatccacccccctcggcctcaccccaacattgctaagctaaagggaaaggtcaagctgggaactgcttaggggaaacctgcctccaattctattcaaagtcaccactctgctcactgagataaatgcatatctgattgcctcctttggagaggctaatcagaaacttaagagaatgcagccatttgtctcttacctacctatgacctggaagtcccctggccgcttccagttttcctgcctttctggactgaaatattgtttgtcttacatatgttgattgatgtcttgtgtctccctaaaatgtttaaaaccaaagctgtgctctgaccaccttgggcacaggtcatcaggactgcctgaggctgtgacacaggcactatcctcaaccttggcaaaataagctttctttttttttttttgagacagagtcttgctctgtcacccagtggcgtgatctcggctcactgcaagctccatccccaaggttcacgccattctcccgcctcagcctccagagtagctgggactacaggcacccgccactatgcctggctaattttttttttttgtatttttagtagagacggggtttcaccgtgttagccaggatggtctcgatctcctgacctcgtgatccacccctctcggcctcccaaagtgctggaattacaggcatgagctaccacgcctggcctcaagtgtgtttcttgtaggtagcaggtcattgtgtcttattttttcatctattcagccattctatgtctttttattttaatagtttagttcatttacatttagtgttattattgatgttttattctactgcggccaagatggcactcacaccacaatacaaagtccttgccactcttctttcccctttccacaggtagaggaacctctctcagtggccaccaccaccactggcccatgggaggttctgctagcccgctgctcatgttctgttaaagcccaagggctcttcaatcagcttgtggtgaatgctgccagtcctgggactcaccctgaattctggcttggggcaggtccagaaatgctgcccaagagccgaggcctagattcctgaactccaagagactgcttgttgcttacctcactgtgtctgagtgggttcctaaggtgccaaattcccctttgtttttccctctgcttttctcaaacaggagactctccatgtagccacgacatctggttttgtgctaagtcttaccggacgccagcacatctcagtctctcccaaggtccacagcatactacctgggtatttctgctggttattcagggcccaagggctctttcatcagctggtgatgactcctggcaggactgggtccttcccttcaaggcagtgggttccctttttgcccaggggtatatgtctagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagtccctgtgctctccctcccccaagtatacaggctttctctccctgcactgctggctactgtgggtagctggctaatttttgtatttttagtagagaccgtgtttcaccatattgtctaggctggtctcaaactcctgacctcgtgatctgcctgcccaggcctcccaaagtgttgagattacaggcatgagccaccgtgcccggccacaggtgaatttctaaatgcatttaataattgatttctagacaaaacagttaaaaagtattagagtatctgtagccagttagttttaaatattatttgatttatttaagtggcatatatgtcttcaaatgtatctcattactattatgataaaacataataactcataaaatacatattgatttcataaatatagtacactatttttatttaaaggttaaccccctggaaaatattttgacacattttctatgatcattgttcgttttatatgggagtaaagaagccactgggattgtaaaataacctgatttattctgagtcagagtttatgcacaagttattgtctctcttttgaaattattacaagcttctgaggctagtccgaattcaatggtgtttacaacgaattgctcacaattacacatttgtttattttccactcctgctgcttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgcccttttagctgttgccttatctctttgctctcttttagggctaaactttcttttttttttctcttgagacggagcctcgctgtgtcacccaggctggggtgcaatggcgtgatctcagctcactgcaacctctgcctgccgggttcaagtgattctcctgcctcagcctcccgagtagctgggattataggcaccctccaccacacccggctgatttttgtatttttagtagagaaggggtttcactttgttggctaggctggtcttgaactcctgaccatggccagggccaaactttctatttctagttctccagtttctgatcattccttaacccactgcaatctggcgttcgcttccatttctccattgaaatagcccctcgctagattttaacatgcacctactaatggcaaaatccagtgtagcatttgacaatgatgaccacatcttccttcttgatactcctgtcttggtttctatctcatttttcttccctgttatcattttgatgtccttctctaacttttcttctgcttgctcttagggtctgatcctcattttattactctaaaaagctctctctggagtgttaatgactctagatgtttcttatattctgctgtgtctaaatttacatcctataactttttttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtgactttgtcaagtcatgtaaccttaattaagtttgttttttaaaactttataaatgagtgtaacagtacaggcatacttaagagatattgtgggtttgattccagacaatgccattaaagcaaatatctattcaataaagcaagtcacatgaatatatatcaataaagcaagtcacatgaatattttttggtttcccagtgcataaaagttatgtttacattgttctataatctaagtgtgtaatagtattatgtatgaaaaaatgatataccttaattaaaaatactttattgctaaaaattactcacaattatctgagccttcagtgagtcataatctttttactggtggggggtcttgtgtagatgttgatggtggttgctgaaaattgggtgaatatggcaatttctagtttgccacatcaatggactttcctttcacaacagatttctctgtagcatgcgatgctgttagatagcattttacgtacggtagaacttctttcagaattggagtcaatcctctaaaaccctgccactgctttatcaaataagggtatgtcacattgtaaatcatttgttgtcatttcaacagtgttcacagcttcttcaccaggagtaaattctaccttaaaaatccctaccttttttgcacatccattaaaagcaactccttatttgttaaagttttatcatgagattacagtaattgagtcacaactttaagctctacttctaggccaggcgtggcagctcatgcctgtaatcctagcactttgggaggctgaggtaggtggatcccttgagctcaggagtttgagaccagcttgggccaatggcaaaaccccgtctctacaaaaaatacaaaaaaattagctggtcacggtggcacatgcctgtagtcccctctacttggtcgggggtggctgaggccagaggattcttagagcccaggaggtcaaggctgcagtgagccaagatcacgacactgcactccagccaggtgacaaagtgagaccctgtctcaaaaaaaaaaaaaaaaaagaaagaaaagaaaaggaaataaaaactctacttttagttctcctgctgtttccaccacatctacagttatttcctccactgatgtcttgagcccttcaaaatcgtccatgacgatcagaatgaatttcttccaaactctcgttaatgttgacattttgacctcctctcatgaattataaatgttcttaatggcatctagaatgatgaatcatttgcagaggttttcaatttgctttgcccaggcccatcagaagaatcactatctatggccccaatagctttatgatatgttattacttagtaagacttgaaagttgatattactccttgatccatgcactgcagaatggatgttgtgcatgaaaacattgatgtctttgaacgtcttcatcagaactcttggttgactagactcattgtaaatgagcagtaatattatgaaaggaatctttttttctgagctcgatagtgggcttaacatattcagtaaagcatgctgtaaacagatgtgctgtcatccaggctttgcaggtctatttataaagcacaggcagaatagatttagcataattcttaagggacctaggagttttggaatcgttaaataaacattggcttcaatttagagtcagcagctgcattagcccctaacaagagtcagcctgttctttgaagctttgaagcaggcattgacttctctctatctacagcagtccaatagaaggctattttgtctacatagaaaatttgttgtttagcgtagtcaccttcatcaattgtcttagctagctagatcttctctataacttgcttcagcttctacatcagcacttgctacttcgccttgcacttttgttacgcagtcagcttctttccttcaatcttatgaaccaaccaacctctacagcttccagcttttcttctgcagcttcctcaccttgacttcataggattgaagagagggccttgctctggactaggctttgtcttaagggaatgttgtggttggtttgctattctatccagaccactcaaactttgtccatatcagcaataaggctgtttcactttcttatttttggtgtgttcactggaatgagtagcacttttacttttcttcaacacttattttgcattcacagcttggttaattggagcaagaggcctagcttcaccctatctctgctttctacatgtcttcctcactaagcttaatcatttcaagctttttatttaaagggaaagacatactatttcttttcacttgaacacttaaagaggccattgtgggattattagttggcctaattacaatattattgtgtgtcagggaataggagatagggaacaactggttagtggagcagtcagaacacatgcaacattgatcgattaagttcgctttcttatatgggcgtcgtttgagtcacccctcaaaaattacaatagtaacatcaaagatcaatatcacagatcaccataacagacatgataataatgaaaaagtttgaaatattgtgagaattctcaaaatttgacggacatgaagtgagtacgtgctattggaaaaatgacaccaatagacttgcttgatacagggttgccacaaactttttctgcacattttgaaactttgtatttgcacatttaaaaaattgtgtatcccgataaataaaatcactggaacaaaaaaactgatactctgattaaactgaattttatagcttgcaggacaccttgggccagcttggttttactctagctttcactgtcattccaccctgcttcttccttcaccaacattcaaattcttttccttatctgccagccaggcagatcggagaggcaagagcggtcttcattttcagtagctcttgattctttgatgtgagaggagcagcacagtcgtttaaacttgatccaacctctttgcatcttgcaaagtcaatcagccaaaagaagtaaaatatgaaggcaatgcttgtgcaatgtacagttcgttttcatgatgtatacctcattatgatttgtctgcttgcttctcctgtttggtcatttctttggaaggcagtggatttttttcttgtgttttttgtcttcttcaattttgacttaccaaatttctcaatcccagccatatcgggtttgttggatgtggttgccaaggaagtggagtaaggcgtttgagcaagcagaatctggtctgctcataactattaaattatttaataataaaagtacttagaattacacttgccacagagtaaccacttagtaaatattagcatattcactcaagtatcactgtttcattgacatagattaaaaccaaaaataagtgacttcagtgattgtcttgcctgataaataggattttttcacacgtgccaatttcattcagtggctctctggcacactgggttgaaggcatattgagattctgtgtgagatcacctggaaagaacatgctgctagattagtgatagttgccataggagagacagtggaggaagaatacgttttgtatttattatccctaatatagctcacttcccagtttttggctgagatatcaggttggttatctatttttccaagggttgtggttgagatatcaggttggttatctatttttccaagggttatggaagataatgctgcgtatgtaaaggggaccattaaatagaccaatggaacagaacagagccctcagaaataataccacacatcgacaaccatctgatctttgacaaacctgacaaaaacaagaaatggggaaaggattccctatttaataaatggtgctgggaaaactagctagccatatgtagaaagctgaaactggatctcttccttacaccttatacaaaaattaattcaagatggactaaagacttaaatgttagacctaaaactgtaaaaaccctagaagaaaacctaggcagtacctttcaggacataggcatgggcaaggacttcatgactaaaacaccaaaagcaatggcaacgaaagccaaaattgacaaatgggatctaattaaagagcttctgcacagccaaaaaaactaccgtcagagtgaacaggctacctacagaatgggagaaaatttttacaatctacccacctgacagagggctaatatccagaatctacaaagaactcagacaaatttacaagcaaaaatcaaacaaccccatcaaatagtgggcaaagcagatgaacagacacttctcaaaacagacacatgaaaaaatgctcatcatcactagccatcagagaaatgcaaatcaaagccacaatgagataccatctcacaccagttagaatggcgatcattaaaaagtcaggaaacaacaggtgctggagaggatgtggagaaataggaacacttttacactgttggtgggactgtaaactagttcaaccgttgtggaagacagtgtggcgattcctcgaggttctagaactagaaataccatttgacccagccatcccattactgggtatatacccaaaggattataaatcatgctgctataaagacacatgtacacatatgtttattgcagcactattcacaatagcaaagacttggaaccaacccaaatgcccaacaatgatagactggattaagaaaatgtggcacatatattccatggaatactctgcagccataaaaaaggatgagttcatgtcctttgtagggacatggatgaagctggaaaccatcattctgagcaaactgtcgcaaggacagaaaaccaaacaccgcatgttctcagtcgtaggtgggaattgaacaatgagaacacttggacacagggtggggaacatcacacactagggcctgtcatggtgtggagggggggggagggattgcattaggagatatacctaatgtaaatgacgagttaatgggtgcagcacaccaacatggcacatgtatacatatgtaacctgcacgttgtacacaagtaccctagaacttaaaatataataaaaaaaattgaccacaaatataactatatacaaatgtaaaaataataataatttaaaaaaatttacaaaaaagaaccttgaatgccaggcatagaaatttggacataatctgaaagttagtaggtgttacaacagggcagtcatgagttgtaaacggaaggttaatctgccactgatttgcaggatcatttgcagtgaagaggagtcagaagtaagaattccagtggttgtcatactgtattttcttgactctaagaagcattttttcacatataagcatggttcttatgtagtagggttgttaagaagattaaatgggttaatacatgtaagacatttaaatcagtgcctggcatatagcaagcactagtacaagtgttagctgtcatcattattacagttattgaacaatcaatatatacatttaatgtagtgttttttaacatgaaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaagttttgtgtatttttgttggagagattggtatttaatttgatgttgggtacttggcagggcttctgaaaatgtcttcagttttaggaaatagaatcacacagggaaaaataatgaatagagccagatgattggtcgtctgccagctcagatgccgatttctctccattggcctctccagtagtatttactgggatgaataaaagtcagttatggctatagctggtcatattttcactgttagtatttatatttaagcctaaattacatgttttgtatgggtatgcttggcaatatttacccatgcatcagcacaatcagttcctgtacacctgcccaagctttccattgcaccaactccacaagatcccagcctaccctttaaatattattcccagggaatggcctactgtgtggtctctagcatgtcttcaccagctgtcaagccttcagtgaataacacctgtgtacctgctgaagcctctcagatttgtctgtagtccagacctctcccctgaggttcaagcccttgcaatattttatccatcttcctacctgcttagaatttctgctggatatatctcataaacccaataggactaaatatgttcaaaactgagtttttaaaaagtttttgcttctaaacccactttttcgctaatatccgacagtttgtgtagtggctctcaactttggctgtacactaaaattaccaggtgagctttagacaatactgtcgcctgggtcacaccccctagatattataatttaattgacatgtggtatgttgtggtatggactgagcaatgaagtttttaacgtttcccatgtgagtttaatgtccagccaaggttgagaactactgagttaatggaatcaccttccatcatctagctggagcaggggctggcaaattatgatccaggggccaaatttgacatgctgtatgggattgtaagtaaagctgtatcagaaaacagccatactcatttgcctatggctactttttcattactgtggcagtgtttgagtatagtagctctccttttttctccatttcactttccaaggtttcagttacctgtggtcaaccacagtctaaaaataggtgagtacagtacaataagacacttagagagagaccacatttacataacttttattacaatacattgttataattgttctattttattattagttattgatgttaatctcatacctgatttataaattaaactttatcataggtatgtatgtataggaaaaaacatagcacatatattataaagggtctggtactatctgtggtttcaggcattcactggggttcttggaacatattcctcatgaattgggggacagttagttgtcacaaagcctaaaatatttgtcatctgcctttgacagaaaacattttcttatccctgcctcctcataccctcttttctcttgcctgcctcaatatctaatcagcagccaagacttactgtttgtttatttgcactaaaatattttgcatacattccccttttatttctactgtttctgctccggcagaggccctcgtccatttcttgcctgttctactgcaataacttccttgcacttctccctttctctagtccattctcactgcagccagagtggtcgtttcaaagaacacagatgcaatcaggccattcccttgcttggaaaccttcagtttccccccataacttagaagataaattctagatcctcctttatcaagcccttgcttgccacatcagccttaattcacaacttgctcttctttcaccttaccctccattcaccttaccctccaacaagacaaaactgctcagaggttttctgcactcatctttacatttgttgcttccatgctttggttcttctcctctcatcttagcatgttgttcccttctttctttttctggtagacactcagttttttactgaatttatactttctcaggaaacttgcctttctctaccatcttcatcatcccccccaagtgccccttatctgtgcctcataatatgccatgcattgttctgtattatactgagaatgttgtattacctgtatacattaatctatttctgtcctcgactgaaaggtccttgaatgggtgatattttactaaatttcagtactctcactgtctagcatagtgtctgacatatagtaggtagccaataatcatttgttgaatgaatacattttctatgtagtgtgcatattcaaagttaaatgtcaaaattttcatatttggttggcagtagaatagtcatttaaaaatcatggaccatttaatgttttattaaattaaattctttgtaattatcaataagcctatattagatacatgtaaattttcagatgaaagttatttggggtgatggagattttgcatgccttcatttacatgtctcagattggtaacacgtccctgctattatatgtagatagtatttttcaaactttactatatttcgaaccacttgagggtcttactgaaatgtagattctgattagttaggtctcgggtgaggcctgagattctgcatttctaaactcccagaggatccctatgctgctggtttacagaccacatgtagagtggcaatgtgctggatggcatatctttagtaggtcttcctttagtagttggtcagaacaatttttattttccttttatatgtttaaatcatcatttgtattgtaatttcatcttccatctttttatttttatgttttagcaagacagtgataatgctaatatgtcaacacaatctccagtatcatctgaggtacaagttctgtttttatttgtcttaaaaatacgttttgtatgttttctgtgttttacataagagtcttccttgccagttctctgtaacctgattttttttgcaatataatttattcactcatattttaaaatccgtggcagattagtttgtacaaaccttctagcctataaaaaattctaagaatgccattttttggtaaaaatattgatactagcacttgtttatttatgattttctgtagtgtctgtagtgtctgtagtgatttttggaagtgtctgtagattgcagaaaagaattcactttatcaaatctatgctttctcattcatccgtattttaaaataaatgatagattttaagaacaactttcaaattttaaatttgaaaaaagtacttcagcattgtgcaatggcctttggtttttcttgtaaccagttaggtctgaaaccaatgcaaaagaaatttcctttttccacgagaaacatccctgcagtgggttgttcctatcgacaggaggttacacgtttttgggagaatgggtatcagaaagttagagtttgtgaaatctcgatcaaatactctggtggcttgaatgactgattcttctaatttatttattcaagtctattgctttacaacaagagataaatttaaaaaattctaaactctatctcttctacttaagattaccttaaagtgtattggcattagtaagtaaatgattacacattcatttgatgaattcaacactttgctcaaagtgttggatggcccaaattcactgtgtaactttggttacatagatgctgctaatatttcattatatgtaggtggtgttgcttttttaataggctaggattctttgttgttgtgggtgatctgcattacaaaacttttgaatggatttggacattaattttataaacatgtttctaaattattcatatgataggtaaaatggtatacacacttttagaaaacaatttaaattaggatatcttaaaattagtctttgtcatatgcttttgtaattcttttactttaagttacaagtataagcatataagtgactactacttatttgtctgcttgatatatgattttatgatctgtgttcacagggaagactattcataccaaatttcccaaataatttacattgatatatatatacgtatatatatacgtgtatatatatatgtatatatatgtatatatatacatatatatatacgtatatatatgtgtatatatatatgtgtgtgtgtatatatatatatatatatatatatatatatatatatatatatatatatatatatatatatatatatatatatatatatatatatatatatatatatatatatatatatatatatatatatatatatatatatatatatatatatatatatatatatatatatatatgacacatgatctcactctgttgcctaggctggagtgcagtggcacgatctcaggtcactgcaacctccacctcccacattcaagcgattcttgtgcctcagcctcccgagtaggtaggactacaggcacatgccaccacacctggctaatttttgtatttttagtagagacagggtttcaccatgttgatcaggctggtcttgaactcctggcctcaagtgatctacctgccttggcctcccaaaatgttgagattacaggtgtgagttttgtaatatattttttatttcatttggatcagtgaaattttcatctaggaattcatattaatttaaccaaaatagtgaagacaaactgggaggcttgtagatttggatagggtggtgagtatgtatgtgctttggtaactcaactgacatttaacctgaactgcatatcacgtgttaacagaagatttaggtaatctacagaattctgattacattaatttcatgtgtgaatggaaaagagtaaaactaattggtgtaatgctttagtattaacaaagtgcttgcctgtatatttgtacctaaaagcagccccataaaataggtatgatcctcatcattttacagctgaagagatgggtaactttccaaactatcttagttaataaatggcagagaagtgactgaagctgagccctactcacttcacagagttgttgcacagattaaataaggtgctgctaagattacattattttatcatcatttagttatctcatttaatcttcacagtaacctcatttgaaagatgaagaaacaatcacagagaaattatatgttgtgctcaaaacatagcctaagctttctaactccatcttcagatttgtttaatgtactacaaatctttccatagcaaaccactgtgtgtgaaagatttgaaaaaatattcattcaaatagaagagatgatatttatcatctatcattctgcagtccctatacaaatatgtttgccttcagattatctactgttaggtgttaagtccatagtagatgctgagtaaatgctaaattcacttaccttttcattgaagcttacttctttttttcggaaacttcagtctgattctttcaaaaagtatgatctattttatacagttcactaatgattttcattttctttctactatgaaagtatttaaagcctatatggttagctcaactagcaaatattagttgacctcttaaaagtgacatgtatcaacttgaattgaaatgcaagttacttttctcttcactaatcataggaaaataagtatttccccaaattggaatggatgtgaataagcaccttgattattttgaaagaaaagaagttttattatttatttatttttaactttttaatttttttttaggaatatgacagaactgatggtttttcacacagtccctttggcttgaagcctagatcaggtaaatagatattctgtaaataaaatttattagttatatatgaaactagtttcccagcttaaatgggattgattccatagtcttaagtacacatagattctttcccctctcctaaaagcaattttctcttaacgatatttgtctttccaattcccattcccatttctttcttcctctttaccttcaagctcctgaaacctcagctttttgccttagatatactgcagtcttatttctactctactgtgactgctgttagaatgaccactctgccagcagaccaaacactgtttgaaattatagcactccattatattgtggttttataaagggatcttttcgcatttggcaagcccaaaagaaaatggatccatgttacttgtcaaggtattgaactatagtttttattcctgaataactgtattgaccttcaagaataatttccttttttaaaagataaaaggctgacatatgttcagtaatcatttttaacctgggccataagtttctaataacgtatgtttgaataagaacatgtataggtggtagaaatcattacacttatcttccctgttgctttcaattatgcacataaatagagttcaaatatattctctaaaaatatttggaatgtattagtgagtaataatattttatgtaattttgtattgattcatcatgcctctttccccatcaatagttgctccttcccattaactttgtaacaagttaggaaatttctgtttttatagcttttagccgctcatctcgccaagaatatggggcagcagatccaggatttacaatgagaagaaagatggaacatttacgggaagagcgagagcaaatacgacaacttcgcaacgtaagtcagattgctctttcagatctgctttgtggaaatgggtttaacttggaaaattaataaggcgtacagatttcattttcaatgctccttaaaatgtttggatatacaacaattagtaatataaacatttaacatgtatgtttagatagagtatctgatttatacctgtttttctatagaatcttgaatccaggttaaaagtaattttgcctgatgacattggagctgcactgatggatggggttgttctttgccatttagccaatcatataaggccacgttctgttgctagtattcatgtaccatcaccagcagtggtaagttttgtttacaatttgttagttctctaaaggaagatatagcttcttaaaattgtctttaaataatatacctcagtgaacttagttttcagttttgattaagttccatagaaaaatgcctaaaagtacattttttccctcttactttacagcccaaactgagcatggcaaaatgtcgaagaaatgtagaaaattttcttgatgcttgtaaaaagttgggtgtctcacaggtaattgttatttatctaacaacgtgatcacttaaatttgaatttattacatgcaaactggggttcttcttagagcaatgaataatgctttctgaacatgaaaatgaatgccttctcttggtaccttctcctaagctccagctttcactgtagcagttatctaatgaatgtttttaagctacctttaaagtaatttataaaatagctacaaatatggaaaatcatgcacatcactgaccaaacataactcggtggccatatttacaacttggttgtgatgtcattgttaccatctttttttccttcttttttttttttttttgctagagaacatttggaccccattgtaattcactggatagattctgattggaagatttgcattcagtgtgaatagctttttaaactttatttaaaatgcaaaattggaaattataccagcatattatgataatacctgtattggacaaactttgaaatttttaggaattgtcttatgtttcatgtaataattgcactactatacaataatcattaaagcagtattgtaaatatgtaaggaagatatataatcacaatattgcttctttgtaaagtgttataaacctaacctcaacatgaatgactatggagagaaatgacattgttatcagagcacaattaagttgtgcttgttaagctgtcttttgaacagtgtcttaataatctggtctacagatcccactttaatctcttccctcaagtaagtaaacataatttaatgtgtagagaatctgaattgttgggtaatttggaaattacataatgttctctaattacctcttgtatatagttgatgtgatggttttgtttttgtttttgcttttgtttttttgagacagagtctcacgctgtcgcccaggctggagtagtgcagtggcacgatctcgtctcactgcaaccgccgcctcccagttcaagcaattttcctgcctcagcctcccaagtagctgggactacaggcacatgccactacacccagataattttttatttttaatagagacggagtttcaccatgttggccaggctggtcttgaactcctgacctcaagtgatccacccgcctcagcctcccaaagtgctgggattacaggcacaagccactgtgcttggctgatgtgatgttttaaatttttaattcttaaaaatgtttgttgtttcttttttctactctcaatctttcagtggggaaatagcaaacttagcaacgttttctgcagccattacattatacagattttcccgttttgccattttttcttttttaaaattaaaaaaacccctttatttatttatttatttatttatttattattatactttaagttttagggcacatgtgcacaatgtgcaggttagttacatatgtatacatgtgccatgctggtgcgctgcacccactaactcgtcatctagcattaggtatatctcccaatgctatccctcccgcctccccccaccccacaacagaccccagagtgggatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggcgtatatgtgccacattttcttagtccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagttgaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattaatttttttataaggtgtaaggaagggatccagtttcagctttctacatatggctagctagttttcccagcaccatttattaaatagggaatcctttccccatttcttgtttttctcaggtctgtcaaagatcagacagttgtaggtatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcaggttaaggagattttgggctgagacaatggggttttctagatatacaatcatgtggtctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcattataatattggctgtgggtttgtcatagatagctcttattattttgagatacgtcccatcaatacctaatttattgagagtttttagcatgaagggttgttgaattttgtcaaagttcttttctgcatctattgcgataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctgaaattctcttttttggttgtgtctctgctcggctttggtatcaggatgatgctggcctcatcaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagggtgtatgtgtagaggaatttatccatttcttctagattttctagtttatttgcgtagaggtgtttgtagtattctctggtggtagttcgtttttctgtgggatcagtggtgatgtcccctttatcattttttattgtgtctatttgattcttctctctttttttctttattagtcttgctagcggtttatcaattttgttgatcctttcaaaaaaccagctcctggattcattaattttttgaagggttaaaaaaaaccctttttttagagatggagtctgactgtgttgcccaggctggactggaactcctgagctctagacttccatttcacaaataactgggattacaagcattcactacctcactaatattatgtcatttttgttttaagggttttatttttagcttcattgcttttctctgaactcagaattggtaatatataataatttttaaattaattttctttgttttaggatgttttccaatttttaacagccttattgagttattaacatacaatatagggcatataaataaagtgtacaatttgatcaattttgacatatgcatacaccatgaaatcatcaccacagtcaaaataatgaacatatctactgccccccaaaatttcctcatgtgtctttgcaatccttctttctccagcaaccactaatctgctttctgtcattgcagattagtttgcactttctagagttttatataaatggaatgatacaatatgtattatatttttctatcttctttcactcagcataattattttatgactcgtcagtgttgttgcatgtatgaatagaccattgctgttcatttctggatagtattttattgtatggatataccacagtttgttaatcccttgacctgctgatggacatttgggttgtttccagttttagcggctgctacaaataaagctgctatgaacatttgtatacaagtctttgtatggatttatacattctttaatttttagtaaatacctagcagtggaataactggaacatatggaagtgcatacttaacattttaagaaactacataactcttccaaagtggttgtactgttttacattcctgtcagcagtatgtgagagttccagttcctccacatcctcactaacattcagtatgatcaatcttctaaaaattttagtcattgtgatatgtatgtactgacttgccagtgcagttttaatttgcattttcctaaagactaatgatgccgatcatcttttcaaggcttatttgccacctgtatatcttctttttgaagtactttgaagtatactttcttttttgaagtacatattctaatctgaggtatattttgtattgggttgtttattttcctatgattgaatttcagatttctttacaagttatggataaagacatttaccagatttataaatattgcatccaaatctttggcttgtcctttcattgtccttagagtgtctttcaaggagcaggatcttcacttattgaagtacaatttattttttaaaatgggctgtgctttttgtgtcaaacctaggaaatcttcgtataatccaaggccacaaagatttctttcctatgtttacttctggaaattttataatcttaggttttgtgttcatgtctatgatcaattttgagttagtttttgtatgtggttaaaaagtatggattgaagttctctttttttaagcctgagattgggcatatacattgatttttttaagaaaatatttttattgagatataattacaatgccatagcattcactgatttaaagtgtacaattaaatggtttttagcataatcacagagttcagcaacagttaacaacaatctgtttaaaatattttcgtcaccccagaaacacagcccttgcccattcgcagtccttcctctgttctttctatggatttgcctactctagacatgacatataatgaaatcatacaatatgtggtctttagtgtctggcttctttgacttagtataatttttccaaggttcatccatttgtagcctaaatcagtacttcatttctttttatggctgaatagtgttctgttctaaatacataccacatgttgtttatccattcatcagttgatagacatttggattgttatcactcattgtttattatgaataatgttgctttgaacatccgtgaataagtttttctttgaacacttgttttcagttctcttggttatacctagcagtgaaattgttaggttatatggtaactctatgtttatattttttaagaaactgacaaaatatgttgcaaagtggctgcactatttttacatttccaccagcaatatatgagggttctaatttcttcacatcatcaccaacaatggctactactgtctacctttttggttgtagctattttagtgtgtatgtgatgtgatatcttattgcggttttgatttgcgtttccctagtagttaatgatgttgagcatcttttcttgtgcttattgatttgtatatgttctttggagtaatgtctattgaaaccctgtgttcatttctgagttagattatttatcttttttttttgagttgtagttccttatgtattctggatacaaattgcctaagagatacatgatttgcaaatattttctcccattctgcaggttgtcttttcactttcttgatggtatcatttacagcacaaaagttactaatttgatgaagtgtagtttatcccattttttcttctgctgcttatgattttgatatcatatctaagaaaacattgtgtaattcagggtcacaaagatttacacctgtgttttcttctaaaagttttatagttttagggcttacctttttgtctgtgatccattttgagatcagttttgtgcatggtatgaggtacggatccaaattcattctttcacatgtggatatccaattttcccagcaccatttgttgataagactcttcttttccccattgaattgtctgtcttagcacctttgtcaaaaatcaggtgaccataaatataaggctttatttctggattctcagttttttttaccactaaattccttattccagtatcacactgtcttgcttactgtaattttgtgatgcattttgaaatcaagaagtgtgagtcttccacatttgttctgtatcaaggttgttttggctatactgagtcccttgcatttccatatcaattttaggattgattagcttgtcaatttctgcaaaaaagccacttgggattttgctgggattaccgaatctaaaatgatttggggaatattgtcatcttcacaatgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataattatttctttaattccactgtcaattttttattgctacttcatagaaatagaagtgattttcttttattgatcttgtattctgcaaccttgcagaactcatttattagttctataatagtttttttgtgtgtgtttctgtgccttaggagtttctctttacagaatcatttaattattctttcaaagaattcatccatttcatctaacttgtcaaactattattatgaagttatttataatgtctccttattatcattttggtatttgtagaatatcttgtggtgtcacttcccttatttatgatattggtaatttgtgtattctctctttccttcctgattagcctagcttgaggtttatgaatttttaaaaatcttctaaatgaactaactttgggttgcattgattttttttatctattgttttttgtttttttactttattgttttcctctctcattctcattatttgcaccattcttttgccattggtttaatttgctcttctttttttagtttctagggtggaagctgaagtcattgatttgaagccttccttcttttctagcatacacttcagtggttatttgaataaataagcaaaatattaagagggcaacaaatatagcagtgaagatggagatgaggcaataattttgagaactctttatgggataccatcattagtatttggagaatgggttatgggagtaaggaagaaagaggaagactattatatttcacaggtttgtcaatggagattgaatagtgtattactaagacatggatcgcagaagggcaaattaatttggtaaagtagttctgttgtggacacattgattttgatatgtctgttagatgtccatttggctgtgtccagttgatattgtatttggagatcaatagagagatcttgggaggaaataaaaacttggaagccatcggtatggaaggggtagttaaaactagaaatagatgagaataccaaaagagagggtatagtgtaaaagagaagagagtgaagacagaacccttggaaacatttggaatgttggaagaggatcggtgagggctaattaatgaaagctactgcacaattgctgtcagaaaagttgaagtagaaaagaatggtgtcacacaagacaggggaggagtaaggttcccagaaaggcattaatcaaaggcataatatgactgagcagtcaactagacatgtgcaacatttgacatttaagatggcattggtgatttttactaaaatagttttagtgggcatatgctttagggttagatgtaagatagcagtggttgagtagtgagtgggaaatccaaaagtggtgaccaactcttttataaacattttctttgtagagaaagaggtacaagtgtggaatgacagcatttcaaacaaggccgacttctataatcttttttcttagtataaattaagaatctaaaaacattttagattacaatatttataagagaaaacttagaattatgtagttttcttgacattttatagaaatcatgtttttaaaatcaaattctgacttaattttattacacttctaaaaaatgaatgttcaaatatctcttttttttctccaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaagaaaaaatttaa

SEQ ID NO: 1128 - DNA, 48043 bp, mus musculus
gggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttagggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttctttctttcttttctttctttctttctttctttcttttctttctttctttctctctctttctttctctctctttctttctttctttttttgtggagggtcaaagtattttcaatagcatgaaaattgaagttttctttttcctttttttatttttgatagagtgttgctctgtcgcctaggctggagtgcagtggtggggtcatagctcactgcagcctcaacctcctgggcttaagtgatcctcccacctcatccttctgagttactgtgactacaggtgtgcatcaccacacctggctaattttttatttttatttttgtggtgacgcgagtgtgggggggtcttcccatgttgcccaggctggtctcaagctcttagctcttgggctcaagctatcctttcaccttggcctcccaaagtgctgggattataagtgtgagccacctcgcctggtcagaaatggaagttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcaattgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgactatggctcataccttatttctcatcatatctttcacaaaactaatctgtagaaattgtatcagttttggtcacacttaatgccctagtgatgttcttcctatatttttgactatcagaggcttcaggtgtgattggctggaataatgggctgaaatccatgaggaaaccagtcactgccaactgggagaatcacacattagtagggccttgggtgatgctgattttttttatcactgggagacttttcagcacaggagggtcaggaatgtgtaggagggttaggacctctctgttttgtgaaagatatctctttgtggttgtgttttttttgtttttgtttttgttttgagacgcgttaggacctctctgttttgtgaaagatatctctttgtggttgtgttttttttgtttttgtttttgttttgagacggagtctcgctctgtctcccaggctggagtgcagtggcgctatctcggctcactgcaagctccgcctcctgggttcatgccattcttctgcctcagcctcccgagtagctgggattacaggtgaccgccaccacgcctggctaaattttttgtaattttagtagagatggggtttcactgtgttagccaggatggtctcgatctcctgaccttgtgatccacccacctcggcctcccaaagtgctgggattacaggcatgagccacagcacccagccatggttgtgttctttgttgcctgttagtggtcatttaaagtttcataatataaatattttctgtgcctccctctatgtaggaggctagaagtttctgctttagtctcttaacaaagctctgtttttgtatcctttcactgagaattgctttgactctatgactaggatttggccttttacagaaccctcgttaacttgatctgtgaatttttttcaaataccaatttttcagatgcctggtgccataataaagggatcttgattttgttttcaacctaaataattattctccatgctgttgttttatcgaccaaggtatgtgtttcaaatttgcccaagtgctgagctctcctcagggtacccagtgatgcttcagcatagggttgggcaaacagtagaaccagtgggcactcgggaggcggaggttgcagtgagccgagatcacgccactgcactccaacctcagcaacagagtaggactccgtctcaaaaataaataaataaataaaataaaaaaaaagaaccatggttgggcttggggacatggaaggaatttatgctgccattattagcatttgtagtagcttgtctgtgatttttgcatgtaaatataagaggacagcttttactgagcctcttaattagctcttgtggaatagtagagaaaagagctgtttctgtctcatacaggcagaacgactggatctacaggcttttctcttctaggttatgtctgtcaagtgcagttgctatctaacagtcagtttttaattttgtttttggaggtgagatatttttaaaaggtgtctttcatttattttaaattcgaacctttgtttaaacgtttttaaagttggtgtcattatactactgttcacgaatgaatcattactactctaaaaaatatatgtgactataaattgaccagaaggatccctcctctctgctccctccctgcttcctgggcaactactgcctttttttttttttggacagagtttttgctccattgtcctggctggagtgcggtggcatgatctcaactcactgcaacctccacctcctgggttcaagcaactttcctgcctcagcctcccaagtagctgggattacaggtgcctgccaccacgcccggctaatttttgtatttttagtagagatgaggtttcactatgttggccaggctggtctcgaactcttgacctcaagtgatccacccgcctcggcctcccaaagtgctaggattacacgtgagccactgcgcccggctggcaacgactgctcttatacctcctcatttctgcttcatcacttctcacttgggtctggtttccactcctgctactccactgaaactgctcttatcaaggtcacctatggcctccttgttgccaaacccaatggatacttctaatgcctgccttactcgactttactatagcatttgatagtttttatcacttccttctcctcaaaaatgaattttttccctttcttcctgactttgccaccactggttcctttttttttctactcctgtgggttttccttctcagactccttcatcagctccttctcctctagcagccccttaatgttggctgttaatagatcaaaccccagatctatatcatagtcttcttcccattttacttgctcccctggcgatctcatctacatctgacttcaaccatcttatgactgcacagtgtatatctccagttgagacccctcgctttagctccagataccacatactcaactatgcgtgtgtcacaagtacatccaactcaacgtgtccaaaactgaatgtagccttttcccctgtaaatctgttcatctgtgtatgttccttacctcattgaatgtccttgttatccccctcggtgctcaggccaacttacccacctggttaccaaatcaattaaggttcctcttagtctttcatctcccttcctcagtcactaaatcttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctgggattacaggcatccaccaccacacccggctgatttttgtattttttagtagagacggggttctaccatgttggccaggctggtctccaactcctgacctcaagtgaatcccccgcctcggcctcccaaagtgctgggattacaggcatgagccactgcgcccagccggtccttatagttttatagtacttcagcacattggctttatttgataatacctaaaatattctattaatatttctttcaattctttcttgccttgcttgtattctataccgatcacaatttaatctttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgacttttttttttttttttttttttttttgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctgaccatctttaatgcttttaaaatttcatatgaacttgaggtttaccttgcagcaggagttctttccacctgtggaaaattccaattccttaaaagttctagttaacgaagttttagcatgggtttgtgtgtagctactttgtgttcatgtcacattctactgcagccttatgaacagaagggggtatttacatttttatggtgactaggtcttaaaatgagtgggctatcggaagtagaaatctgagctgtacagaaactttttactacaatattatacaactttagagatgttatctatgtaagaaatctgtttctttttgccaacaataatactgtactcttaagttttatattaccagtttggggtttcattcattcatttattttttgttgttgttgtttttgtttttttttgtttgtttgtttgtttgtttgagacagagtctcgctctgtcgcccaggctggagtgcagtggcgtgatctcggctcattgcaagctctgcctcctgggttcacgccgttctcctgcctcagcctcccgagtagctgggactacaggcgcccgccaccacgcccggctaattttttgtatttttaatagagacggggtttcaccgtgttagccaggatggtctcgatctcctgactttgtgatccgcccgccttggcctcccaaagtgctgggattacaggcttgagccaccacgcctggcctcattcatttatttttgggatggagttttgctcttgttgcccaagctggagtgcagtggcacaatctcggctcctccgcctcccaggttcaagtaattctcctgtctcagcctcccaagtagcggggattacaggcatgcaccaccatacctggctaattttgtatttttaaaagagatggggttttgccatgtcggtcaggcaggtctcaaactcctgacctcaagtgatccacctgcctcggcctcccaaagtgctgggattacaggcgtgggccacagcacccagccaggcttcttttatttaaagcgaaagtaatgttcatgctttctctttttttttttttttttttttttttttgagacaaagtctcactctttcgcccaggctggagtgcactggcgcgatcttggctcactgcaatctctgcctcccgagttcaagcgactctcctgcctcagcctcctgagtagctgggattacaggcacacgccaccacacccggctaatttttgtatttttagtagagttggggcttcaccatgttggctaggctggccttgaactcttggcttcaggtgatccgcccatccgcccacctccgcctcccaaagtgctgggattacaggtgtgagccactgcgcctggccctatttttaacttttttcttggtttgtttagatggagtcttgctctgtcacccaggctggagtgcagtggtgcagtctcagctcactgcagcctctgcctcccaggttcaagcaattctcctgcctcagcctcctgaaacattttttaatgacatagtattttaatacactttccacagataggccttaactgattgttccaatgctatctcctggtcgtttggttgagaagtagaatagaaactatcctatatgaaatatttttaagttagcacagtaatgttcttgcctttgactagtttaacatatagtattttttctttttgatcatttgataatggaatatgaggtcttctagggaattgatctaaaataactctttattttaacaggttacttttgatccagaagtatttttcaacatattacttcctcctatcatattttatgcaggttatagcctgaaaagggtaagtccttttgtctttcatatactttgaataatcttaaactcagtgggctttgtaatatttgacacttcagaaatgggctgttctttccagattaccctcctttctcctctccttatcctttttagatgctgaaatttatacctgtacaagaatgctttctcttatttatcctagtgaataatgcatttaatcctagtgaataatgcatttcatattagcatagcatagaaaaccttttctttttcaagtaactggtaagtattctaacagtgtaacttttttttttttgtcagagacatttttttcgaaatcttgggtctatcctagcatacgcttttcttggaacagcaatttcttgtttcgttattgggtaagtattttaagcttaaaatactttgtggccttcaaattataattttaaaataatatatttttgatttatgcagtgttatatattcctgactgggtctaaagacttttgcaatattcacgtaggtaataagttgtttgaattttccttaaggccaaagtattaccatatttcaatgacatgaattaaatttgggattagtcacaaagtactacagtaaacccatcttcttactttatcctaatttttttaacagttgatatttttttctaaagtaggactgtgtttattgaacaggtcaataatgtatggctgtgtaacgctgatgaaggtaacgggacaacttgcaggagatttttactttacagattgcctactgtttggtgccattgtatcagcaactgatccaggtatgttttatatgagtggagtttacatacttgaggtgcattgttttgcagtcaaatacatgtgggtttttctttctttgaggtgtagaattcatgattagatacttccttagtactatactttctaattgtggaggaaaaaacaaaattcatgattccttttggcttcagcacaaatttgttttccttttcctttttttttttttaattacatttgcctattactggtccacaagttgacgctgtttcaacaaggactataaggtactttcttcagaaattcatgttggtctttatccctagtgattgagtatagaagatgaactagattatagattagtttaaatgggtaataattatatatttcctttcaagcttttagaaaaccagttccctaaaaatctttcagtttctattcagctgtatgcatttaacagtaagaaaaaatgtttacaaatgattgttagaaggcagttgtgctaatacaggtttgatttggagtcattggaggactttaatatacattaaagaattgtttttataaaattggctttatgattatacagttgtttgtttaatattaacacaacttgttcccctgtgctttaagtgtcagatcttctaaaagttgtgttccagaatgaatttaattgtactgagttaggttttagttttcctgatagagtattggtaaacttaacagctacattcaaattaggaatttggagaagacacagaatggaaaggttggggtaggaacatagactgatgtttttgaactaaggatggaaattttcttttagcatgctttaagactttcgttgaagctcattttgttttactttttaaccttgtaagttaatcatctttaattgtcatccagcacaattaaaggtagaatcctaaggttatctctgcattcctgtgttaactctgataacacagggctttatgggaaggagaaaaatgtgttcaatactctatgagagatattttggctggacacagtggctcatgcatataaatgccagtgctttgggaggccgagatggtaggatcacttgagactgtgagttcgagaccagcctaggcaacacagtgacaccctgtctctacaaaaaaaaagaaaaaaaatagctgagcatgggagtgcgtgcctgtagtcctagctacttgggaggctgaggtgggaggaccacttgagcctaggagtttgaggctgcagtgagctgcagtgaggctgcagtctcattctgcctgggcgagaagggcgagaccctgtctccaaaaaaaaaaaaaaaaaaaaaaaaaaagattttaaaggattagttagagggccattttagagaatttgtgtagtttagcatttttaaaactggaaattaaattgcttccttaaagaccaccaaagctgtcctctcattgtttgtagctactcccattatcaacatgaaggtaggatggttttggcaaggagccggtggtctctggtttctgtgtcctttcattataagcaaggttctcaacttttcaaatcctatgagaaatctgagtccatgagtccattggcttggctacattatttcaactttctggttttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctgtctcttaaaaaaaattaaataaataaaatgcaagtttcttgtttttatgattggcatttgaaaaggctctctcagctgggtctggtggctcacgcttgtaatcccagccctttgggaggctgagacaggtggatcatgaggtcaggagattgagaccatcctgactaacacggtaaaactctgtctctactaaaaatacaaaaaaaattagccaggtgttctggcgggcgcctgtagtcccagctactcgggaggctgaagcaggagaatggcgtgaacccgggaggcggggcttgcagtgagccgagattgcgccactgcactccagtctgggcgacagagcaagactccatctcaaaaaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggcttcttattaagacaaatccagcagctgtaattctggtcataaattttaccccaaccaaaaactaaacctatgttttcatttcctactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaaaaatatttatataaaattacggggtctttaatatggtaagagaatgtttattaggattgaattctaggaggaaatgaatttctaaataactctcagagtcatctactgaggagaatatgttatatttgtaatgtctaagtattcctctgactctttttacttactagtgactgttcttgctatattccacgagcttcaagttgatgttgaactctatgcacttctttttggtgaaagtgtcctcaatgatgctgttgccatagtgctgtcctcgtaagtgtttgttttcttattatattctgaatattaagtgtgagggtactaggaactgaaagtcacttattgaataaagtacattatgaatggaaacatttggaagaatgaggcatttttttccctcttgaagaaatccatattttatagataaattggaaaatacagggaagagaaaaatatgtactgccaccacctaaagacaattactgtaaacattctagaacatttccttttctatgtatgatattgttacatagttgtgattgtagtgtctgtataattttgtattcggttttaacattacaacatgagcatttaattttttaaattagatttaatattttctttcttttttttttttggagataagagtctcactctatcacacaggctggagtgcagtggcgtgatctcggctcagtgcaacctctgcctcccaggttcaagtgattctcctgcctcagcctcccgagtagctgggattataggcacccgccaccatgcccggctaatttttgtattttagtagagatgggttttcaccatgttgcccaggctggtcttctcctgacctcaggtgatccacctacctcgatttcccaaagtgctgggattacaggcgtgagccactgtgcccggccttaattttttctgaatacataatatattcacgtggctcataaattaaagtcatgtaaaaagttacacacagaaaattcacactcttacatctgtcctcatccacctgtccccctagttccttgtagataactttttttttttttttttgagacgaagtctcgctcctgtcccccaggctggagtgcaatggcacggtcttggctcactgcaacctctgcttcctgggttcaagtgattcttctgcctcagcctcctgagtagctgggattacaggctcctaccaccacgcccggctaatttttgtatttttagtagagacggggtttcaccatgttggccaggttggtctcaaactcccgacctcaggtgatctgcccgcctcggcctcccaaagtgctgagattacaggcgtgagccaccacgcccggcctagataaccatttttattagtctcttacctatcttagtatttctttattcaaatgcaggcacaaccgtgaataaatagtcttatttgcctctcatttcttatttttaaagttacatactgtctatcttctggagaactttgcatgtcaaaagagtgaatattctcattctttgcagctatatagtattctctgtgtgaactgcattattgtttatttgctcagtctcctatagcaggacatttgaagggtttttaatcctttgctgtcccaaaaggtgctgcagtgattaaccttgaacttaccttgttttatacatgtttaggtataatggtaggctgaatgtcccaaagtgagattggtaggtaggttaaagggtaaaatccatttgtaattttgttcgacattgttaaattgctcatcaaagaaattgtagcacttcgcactttcaccattaaattattggtctgtttcctcacagtttcgccagcagaatatttgtcaaacttttatatttttgctaacttgataattgagaaatatctcattgtagcttaatttgtgtttctcttatttgacataatcatttcaaaacatttttaatctctagaagtgttaatatatattatagatatgtagttatgtattacttataccaatttaattgcagacaattttgaatgagcaatattttttatctaattatagaaagtactatacatgttactataaggtgtttgcaggttgaagaatgagtctgaacctctgaggaattcaatcctgcctccctaatcttttttttttttttttttttttttttgagacagagctttgctctgtcacccaggctggggtgcagtggcgcaatatagactcactgcaacctccacctcccaggttcaagcaattctcctgcctcagcctcccgagtagctgggactacgggcatgtgccaccatgcctggctcatttttgtatatttagtaaagacggggtttcactgtgttggccaggctggtttcgaactcctgaccttaggtgatccacctgcctcggcctccccaagtgctagaattacaggcgtgagccaccatgcctggcccctgcctacctactcttattaggcaaatatctaactctataggcagttgcccttacttcataccagaactttctatgagagagaagtaagagcccttcacattttctctttatttttatttctctccttaattttcactttgttagttatgaaagaataaaacatcactggctctgttttgcatagcctgattgtcttctgcaaagttggaaattattatttctcagatgtaacattaatcccttaaacgttgtatgtgaagatatacaaaaggccatatccttttttgtgaatgcaatgtatgtaaatattaccccctccccaccatatttattgccagattttttttgcagctgtctgcaactaatataaatttaacttgagaaataaaacctaaaggctgtaactcatattgatactgaactttagcaccttcaatgatgataggtgcagaataagagttttgtattatttgaagtaagggagaaatggatagtatggttataaaaaatgttataaaaaatgaagcaacaaagattgttgaagcttccagtacgtaggtacatgagcgattaccagcactacaaagtaaagagagtaggtacaggcagtcacttttagcatcgattccctatcctagacaactattctactgttcagtcatcttactagtaactgttgtcttatcattgccctaatggcctaatggattaagagttagaaaatctctgttctggtcttatcttaaactgatgtgccctgtgccttagtttttcctattaataaaattgcctgtttcctgcatctttaggaacagttgattagcgttagaggaaaagataaaaaccctcattgaaagattttgagcttggagttataaataatctatttcctgcaacattaggaatagttgattagtgtgaaaggggtcaaaacctcattgaaagattttaagcttgggggtgtacataccagtgttggtgaagaataaatgctaaaaagagagagccggctgggcgcagtggctcatgcctgtgatcccagcacttcgggaggccgaggcgggcggatcacctgaggtcaggagttcgagaccagcctggccaacatggcaaaaccctgtctctactaaaaatacaaaaattagtcaggcgtggtggcacacgcctgtaatcccagctacctgggaggctgaggcaggagaatttcttgaacccaggaggcggaagttgcggtgacctgagatctcggcactgccctccagcctgagcaacggagcgagactgtctcaaaaaaaaaaaaaaaagagagagagccctttccatagcatttctcacaaagggccatacttcttctcttgcagcctttctcaaacagggttttctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaacaaacgtgataaactgtttaacttcactaattaccagagatacatgctaggatcagtagccatttctacctattcaattaacaagacataacttttttttttgagacagagttttgctctcgtcacccaggctggagtacaatggcgcggtcttggctcactgctacctccgcctcccaggttcaagcgattctcctgccttagcctcccgagtagctgggattacaggtgcacaccaccatgcccagctaatttttgtatttttagtagaggtggggtttcaccgtgttggccaggctggtctcgaactcccaacctcaggtgatccgtccgcctcggcctcccaaagtgctgggatgataggcaggagccactgtgctcggccagaattgttaatgataatgacatagtacagtcattcttagccaggggcaatttgccaccccctcaccacacacacacaggagatatttgacagtgtctgggggcattttggctgtcatcaatgggggggggttcctattgacatggcctagtgggtagaagttttcaatgcacaggacagcattcccctcaccccacccccatcacagccaacaaataaatacctggccacaaatatcaataatgctgtggttgagaaaccctggtgttgtaaaactagaccactcatacattgttaacattgaaattggtattaccttttatcactatttatgataatgttaaaatatgtttgtggcaaaaatttaaagcatttgactcaaaaagtagaaaattcctgaaatttcagctcagaaataaccactattaggattttaatccagactttttccgttaagatagtagtatacatataaatatgttaataatctttataaacaataaaggcatagtagtatatatacttttctgtagcttttttacttggatattatactatattaatacctctattatcacattgggtggatgcattacaaatttacctctccaatcccctattgattgattaatatttggtattttctaatattgtattatgactagcatggcagtgagcatatttatgtgtaaatctttgtgaatccttgtaaatatttctgtagggtattttttaggagtagaattgctaggtcaatggtatgatcattaaaaaaattgggagatattatcatatttccctccaaaagtgtaatggagaccttttggaaggcagtggagcaacatgtaaaatgagccataggtatagtaatagtctatttttagaaatatagtgcaaggaatagtctaaaatatataaaaagcaagaagatgttctttcagttatttatagtagcaaaaatagtagaagcaactttcaaatgtctaacaatgaggaaatggttgaataaattgtgctgtatccatttggaccattgtgaagtcttaaaaactgtagttataaagactatgaatttttttttttcttgagatggaattttgttcttactgcccaggctggagtgcaatggcatgatgtcagctcactgcaacctccacctcccgggttcatgaggttcacctgccttagcctcccaagtagctgggattacaggcatgcaccaccatgcccggctaattttgtatttttatttttagtagagacggagtttctccatgttggtcaggctggtctcgaactccccatctcaggtgatccgcctgcctcggcctcccaaagtgctgggattacaggcatgagccactgcgtccggccaagactatgaatatttttatgtcattgtcagttaaaaaagcataattcaaaaccacacattcactgtgattacagctaaataagaattagcatgcatgtaacacaaagaggggaaaggaatacagaaggaaaataaaatcgatctatcagggtagtggaatgatgggaagatttttccacctaaactgtacattttattactttcagggtttaaaaaaaagtattcataaaaaatgctactgcctcaagataaaatatcaattgatacagaaaagatgagttaagatttcaatccagaggctagtgtctgcctaagagagaacaaaacgagcctgtcatctgttctcagcccatcatgtttcccatgtgtccttatacattttaatgattaaagaatgaaataatgattagtgtgaatcttgaatttacatgaactaatccagggaaagcaacctcaggaggcatggcataggtattttgttccagagagcattttgaaaaataccaccaaagaaaaagaagattgtatagcaatttttttcttttctccagccagttactgtattttcatgttataatgaaatcagatctcatttatggtagtgggaccctttatatatatgtaggtaaggtagcatggtgttaaaggccatttcatatttatcaaaatgatatcaaatctactgttccaaaatgatctggttgctttgcacatttaaacgtaaatgtttaacattttcaatttagagtgagtctcagaaatttctggatcccattatcagaaattaatattagtgctatatttcaataaaataagtacaaattaggagattttagtttgatcttagattttttttttaacctgggagatatgaaaagaacttgtatatggtatagcaaacatttttcagccttgaatcagaaaaaaacattgcagcaaccacagggagaattcattatatttttaggaatgtgtttttccttcttttctttgacgtgatttgtatgatgttgttgagtctggactttttataatgctggtctctcaattaactgagatgagaactgatttagtaacggtaagcaccgttgccaaagacctgctggcaacagcaattttctcaggcatttctatttcctggggtggtaactgttacaaaagaagctttttcagaccaggtttggactgtgagttcaagatggagagcatctcctataattgcctgtcttggcctggtatagagtgactttctttcagaagtttgaggtggaagatccagctggttatgctgaaagtactgttgagtggattctaattccttgggaggtctttcgagtgctttttcctataatagtccatttcagtgaatgaatagatattaggcatttggcccattctagaattctaaaagttggaagggtccttcagttacctttttttctcataggaaaaacaaaatgtgactgggttgagtattgaataatgttctttatgttcttatgcctctactggaaacaagtgggatttttcattagtttgttcacattagtatgttaaggctttcggacactcagtactagtaattctgaaacagaatcacaaaagaataatactgcacagtatcttggggatgggggaaaaagcttggtgcaattttcatatagaggattttacaatgttctaccccccccccgaaattaacatttaagggaaagccaagttttcttgctagccagatacattgcaggatttttgggtaattttgtccttattttggcaattccaatcgaaagcttgtttttcttctccctctaatttcatctttcaagctctatactacataatgtttttttaaaagtaaaggttgttttcagaagtaaaagcagtctctcttctgtagctcaatagtggcataccagccagctggagacaacagtcacacctttgatgtcacagcgatgttcaagtctattgggatcttccttggaatcttcagtggatcttttgcaatgggtgctgctactggagtggtgacagctttaatatccttttgttatatttatcttttcttgttaacataatatagtagttgaatgctgtattccgttgtttttcctagttctatgattagaattatgttagaattattaatcttataactaagtacttggtttgaaaacattaagcaacagtctttgccaataaataaataaaagaactgtattgttctgcatagggtttggtgccctaaaactttcactgcaagtgtataattagagatgatatctctctgagggtgaattttatagttgtagattaaatagctgtaaaggtagacatattccaaagagcctctgggtgttctgtgttgctggtcagcctggcagtcttttgctctttgtttaataggacaaataggaaatgtacaacagcgacgccgaatgaacaaaatgtgtttccttggttaggatatgtaagagttcatctcagctctcccgattttaaactttgtgctctagagccctggacgggaagcccaaaggacctgagttgtagtcctggtactaccacttagtcaagttattcttgtgttcatgcaaaggccattttatcccggacttcaccaccatgcaatatatccatgtcataaaactgcacttgtgcatcctgaatctataaaaacaaattttatttttatttatttatttgtttttttgagacggagtctcactctttcgcccaggctggagtgcaatggcacgatctcggctcactgcaacctccgcctcccgagttcaagcgattcccccgcctcagcctcccaagtagctgggattacaggtgcgcaacaccacacccagcaagtttttttatatttttagtagagatggggtttcatcatgtcggccaggctgatctcgaactcctgacgtcaagtgatccacccacctcggcctcccaaagtgctgggattacaggcatgagccaccgtgcccggcctaaaaacatgttttaaaccccccacccaaaacaaaaagccagaaggcatgtctggatcacctgctacatgtgctgtgctctgtgtatcaaagctaaagaagacaaacatgacctctgcctccctggtgctttcgatatagtggcagacacaaacatgctagaagctttgacacttcacctctttggatctcagtgtaggaaattggagggtggggacggtaggaaagaggagtgggactagatgatgtctaaagagtttccagctctggcctggtgcagtggctcgtgcctgtaatcctagcactttgggaggccatggcgggcggatcacaaggtcgggagatcgagaccatcctggccaacacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcaccaaattacgggagttccagttgttggagacaggcctgttcttcttgatgtcctggagtaccttcctcttggctgaagcatggggcttcacaggtaggtgacttgctccctttgattgtcaacccttaaaaggagtgactttgccagtcaattttgctccaagtggatcagctccgttagtatttgaacatacttattgtggttgggatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggcttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaactactgctgtgtgacgtagataaggttaacttctgatctgaccagacctactaagagatgacataaagaaaattaacttctgatattactagaccttctaagacatgacataggtaagattagcttctgatctgattagacctactaagagaagataaacttccttcagtccgctcaggtgctgcaaagctactatgtttccaggaatgtcaggggactagtcagtggtctggttttatttggtactgaatgatcagttgtgcagggtatctgaagggaattataaaggagataggaatacaatttttccagtcttaggaggtatgtgggacaaatacatgaaaaaagtgtaatgtctggaatagaaataggtgcatacttgattatggctatagtgagaaacagaaggtttaaattttgccaaatgacaagaaggttgtgggattcgcctgaaaaggagtggtgctaaaagcaggagcaacagtatttcttcttccggctagagccacaaatcaagtttatgacctatgcttttccccagcccctcaaaagagattaggctttttcccccaagtgtatacattagggctacaaatcctttttacaaattaattcagtgcaataagtaaagagaagaaaatcagctggcagggggcggtgggggaggggagtcagcatttttccaggtcgtgggaagggaataaaaaacaagaacaggccgggcgctgtggctcacgcctgtaatcccagcattttgggaggccaaagcgggcggatcacccgaggtcagaagttcgagaccagcctggccaacatggtgaaaccccgtctctactaaaaatacaaaaattagccggatgtagtggcttgcgcctgtagtcccagctactcaggaggctgaggtagaagaatcgcttgaacccggaaggcggaggttgcagtgagctgagatcgtgccactgcactccagcctggatgacagagcgagactctgtctcaagaacaaacaaacaaacaacaaaaaactagaacagggtaagagcttccagtgttgttggtgatatgatatgaagcttatgtacatttaagaaatatgaggaataggaatcctagattatgtacttcagattatatgtcatagaagacatcagagaagtaggggaaatggtttgaggcttgaggatctggaaagtatcctagaagaaacagtacccttagaaggatggggaagatttaggaaggcctaggggaggcagtacagataaaggcaggaataaaaagaaggcagtaaagtgtagagcagagggtggcggactccagccctccggccacatccggcccttgccagtgagctaagcatggttttctttccatccatttttaattggttggcaaaagatcaaaagaagaatatgttgtgacccatgacagttatatgaaattcacatttccatgtccaccaataaaattttcttggcacacagccacacccattttttaaaatatatagtctatggctgcttttgtgcttcactggcagagtgaagtagttgtgacagagacttcttggcctgcaaatcctctcatgtttactctctggccattcatgggaaagtttgccgatccctatgttgcaaagtaaagctgggactctggagtcactgtattgttttaaatcctggttctactacttgctggctgtgtgaccaggaggaagttccataacttctctgtgcttcagttttgccatctttgaaaatggagataataataatacctacctcactgagtttttgtgggattaaaacgagataatgcatatgaagtccttagtatagtatcagacacacggtaaaaactgaaaaaggtatagctgttatcattagtataaataagtagtaataatagcatattaaatcatttaaagaaaaataaatatacgcttacttattttaatttttattctcatttttgggtaataaggcaaccctggtttaaagagattaactaatttgcccaaagccacacagccagcaaaggggaagacagggctcaagcctaagcattttcattcttaagcccatgttcttaaccactattctgttatgtgtcagagggctcattgtagataactctggtggccagagggacacgagattatgaagggccttaacttcattcagcaagtatcatataccattgccaaggctatgatgtgaatgggatggggcaggcgggcagcagggtttagttccccccacagatagttctgctatcctacagatcgatctcttccacaatgtggaagcccctatctgtaggacgcttactccctatacgagaggaagacccacgcaaaaagtgaagtcacagggcaagctgggagtacgagagttctcacgaagcactctatgctaggatcagaaagttgaaatgaatcttatagcttgcaagaggaaagtatcttgaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagaccccatctttacaaacaaaattttaaaaactagccaggtatggtggttcatgcctgtagtctaagctacttgggagggtaaggtggaaggatcccttgagcctaggagtttgaggctgcagtgagctgtgattgggtcactgcagtccagactgggtgacaaagggagaccctgtctcaaaaaaaaaaaaaccaaaaaaccaaaaaacagttggaaggaagaaactgagtatatgaaagagaggaggcaatagtgaaagcctcttgagaaggcaggaatgaaatccaaagcatgtagagagaaattttgccttcactggaaggagagacaactccaccatgactacaggagaggatagggtatgtagaaatgaaggcacatttgtaagatggagccatcctctctgatggcttctatgtttatctgttaagtaggaggtgagatcatctgctgagagtaagatagggagttatctattgtgtaacaaattaccttaaatttagcagcttaaaacaacagacagttattatctcacacagtttctgagggtcaggaatcctggagcagctcatctgggtgattctggctccaggatctcttaagaggtcgcagttgtgctcttggctgggactgcaccttctcaagacttgactagggccagggaatccactgcaagctcactcaactcacatcactgtcagcaagaggcttctattcttcacgtggatatctccatagggcagcttacaacatggcttcttcccccaaactgagtgagctgagagagccctaaaatgaaagccgaagtgccttttgtaacctaatctttgaagaggcataccagcgtcacttccataatattctgttggttatacagaccaacctggtacagtgtgggtggggactacacaagggtgtgaatactaagaggcagggatggttagggactatcttgggggatggcttacacagatcatagggattttgaggaagatggaggttcgtgaaatagttgttgtagagagtgggagaataagttgaccaaagaaactcaacaggactgctaagaagtactagggatccattgtgtttgagaaataggaattagcagtagaaccaatctgccccattgaatgagtttgtccagcagtacttactgtaagcatggaaaaaagagatagttggctccttccaggtttggagttttttcaagtgggtgcaatgaaaacagaaggacaagagatcatagtgttattacatgactgatgcactctaaacacttcatttaatgtttaacattaaaaggtgttattaacatgatgataagaagggaagtgaggaaagaagacattgtttaaggaaagaatatagggatctttggactgaaggtcccagtgctatggaggaatgatcagagtgggatagttgaacacaaaatatggaaggagcaattgtggtcagtgggaatgtttgaataaggaatttttaaaagaaatattttaaaacctcacatcagaatgaagattctgccaaagagattagtggaagtttttttttttttaattaaaactctagataggatctctgttagaaagcgaagtattactgaaatactattctgcagagccttagtctgtgaatgaactttaggcaaaaaagataaagtactgttaataagagaagttcttagctgaaagataaccatgagatcagtaacttaatgtcctgctagtcttggagaaaatttggagcagtaaagtggctcgatccactatacttagtctggaaacaaagctaaatattctctgtaggtttctgagtctgttaggaattaaaattcctcaatacaaaatcctaccatgaaaatggcctcgtaacaggagagagttgctctatttctggctatgttagttaggacataggttggtttcatgtgaaaagactcaaactaatccaggtttaaacaacatagaaatttctttcttatctaaaaatctgaactggtatggcagttctgctgcatagggtcatcagggactgaagcaatattgttgctaacatccttagggacttgctgttgttcttgtgatccaacgtggctcacccctgtctgcccgttgccttgaagggcttgacccagaatgtgcacacgtcccttccacttaacatcattgattacacctactcacaagggaggctaggagttatatactttatctgggtggctgcataaagatgaaagggaggagtgccaactaccaaggaagaaagcaagaacagatgttggggagaactagcagtcactgccacgttggcccacatgtttcgtggttacattttcttttctttttagggaatcactttttaaaataaatgtttgattttagaatagttttaggtttacagaaaaattgtgaagataatacagaaagttctcatatgccccgcactcagtttcccctattattaacatattagcatggtacatttgtcacagtgaatgaactaatattgatattactaactaacgtttgaactttattctgattcccatagtttttccctaatgtcctttttctattccagggtcccatccaggataccacattacatttagttgtcatgtccccttaggctctgcctgactgtgacagtttctcatatgtgttcattgtttttggtgacccttgacagtgttgaggggtactagccatgtgttttgtagaatgtcctgcagttggaacttgtctgatattttccccatgattagactggagttacatgttctttgggaggaagaccacagaggtaaaatgccattctcatcacattatatgaagggtatatacttaataatgttgacgatagtcttaatcacttggttgagatagtgtttgtcagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccgcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcttcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtagatatatatactaactcatatatacacatatatctatacatatttctgcatataaccatctgtatctctgttaagctcaatatgggttcatactgatgtctccaactttaattcattaccacatggatgattctggcctcctcctctttctgaactgtaaactcccattctaacagtaagaaaccttgttgtcaccacttgccatccatttacctaattgttcagtttcagtatacatgtataatagtttcagaattgttaaccagtgttcccatgggaaacagctttgtcatgagcatagaatgcttttgtgcagtgtcttctgtctttagtcttacagattcttctgttttccaaagttacttagaccaacaccattccccctaccttgtttgttttgagacagggtctcgctcttgtcacccaggctggagtgcagtggcacgatctcagctcactgcagcctccatctcctgggttcaagcaattctcgtgcctcagccaccagagtagctgggattacaggtgtacaccaccacacccggctcatttttgtatttttaatagagacaggtttttgccatgatggccaggctggtcttgaactcctggcctcaagctatcctcccgccccggtctcccaaaatgctgggattacaagtgtgagccaccatgtctggccttgttctgtttttaatcttagattttcccttatatttttctcaggaaatgggatggagactgtatcgtgactcctgaaataaaaattgccatcataaagcaggagtcccatagacagcaaactggagaaaaagatactaaaattggtttctagttaaaaccaatctgaattcacattaaactttccctttgaagcaagttggaagtataaacttagtggagtacagtgggactggtagccattttagtgctgtgaggtggtgattcagctgcccttttctttgttctgaggaaggaaggggaagttttctcagtattactcttcttcctaccaacactgacaatgaaagtgaattaacctattctattaataatcttaaaagtatagtaaagaaactgcttttaaacgtgtttctcttaatctagtaaatttcctgcatgttacacttgctctgtctgatttggtagcaactagccaaatgtgattattttaatttgaagtaattaaaatgaaataaattttcagttccttgatcactctagccacatttcaggtgctcaccaaattggacagttcagatatagaaaatttccatcattgcagaaagttctgttggacagtgttatgttagacaatggaaccaagagactgtgtgttagaaactgagttccctaaaatagtctttcaccatcttgagtgtatagtctaaataatattaatagtaaaatgaaatgatccttaacctattaataattttaggttgctattttcttgggaagagctgccaatatttaccccttgtccctcttacttaatttgggtagaagaagtaagattggatcaaattttcaacacatgatgatgtttgctggtaagttgtaactttcttctcttgcccacttcaagcaaccattcacaatgcgtgtgccagcttgatgtaacactgagatgttatgctggtcatataatactcctttatttttatattatttatttatttagagacactgtttcactctgtcgcccaggctgtagtgcagtggcacgatcttggctcactgcaacctctgcctcccaggttcaagcaattctcgtgcctcagcctcccaagtagctgggattacaaggcatgcaccaatatgcctggctaatttttgtatttttagtagagatggggtttcgccatgttggccaggctggtcacgaactcctgacctcaagtaatccacccaccttggcctttcaaagtgctaggattataggcatgaggcaccacgcctggcctataatactcctttaaacattgaagttgcatccttgaatagaaaaagaaaatgtatatatatatatatatatatatatatatatatatatatatatatatatatatatatatagtgtcccattcccttctgtgggaatttttcatattctgattccaaatccttggttcagaattatgtcatacaaagtgagaaagataaggatgaagtcattttcaaacaaaaaccagtaggtgaatgtatagcagttcttttcataattgccaaaacctggaaacaacccacttgtctgtctctcagtggtcaaatagctaatcaaactgtgatacatccatgctatggaatactactgtgcactaaaaagaacaaacaatttacccatacagcatggatgaatctcagaggcattatgctaagtgcaagaagccagtcttgaaaggttacctgctgtgtgattccctttatatgacattcacaaaaagacaaagtcgtagcgatggggaatgcatcagtggttgccaggggtttgatggagtgacaagaggttagactaaaaaagggtaatacaaagaaatttgacagggggagggatgatgaaaccattctgtgtcttgattgtagtagtagtcacacacacctctatgaatttgccaatattcatgtggctatagaccaaaaagagtgaattttactgtttgtaaatgaaaagtgaatttaaaaaaattactgaaacatcaatgcatgtcagtaagtaacatacacaaattctatttctgtttgtactttttttttttttccgagatggagtcttgctctgtcactcaggttggagtgcagtggtacaatctcagctcactgtaacctctgcctccctggttcaagcaattctgcctcagcctcccaagtagctgggattacaggcatgcgccatcatggctggctgatttttgtatttttagtagagatggggtttcggcatgttggtcaggctggtctcgaactcctgacctcaggtgatctgcccacctcggcctcccaaagtgctgggattacaggtgtgagccaccatgcacagcctggacatatttaagtatgttaatatttactgcatatttgttcacatgcttctaagtttttagaacgtgctttcttgctctgaatttatgaagcttgcattggtaatgagttattgaagaaataccttttctgttcccctgtaggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcaggtaagtactaactagagacctcattttaagattaaattttaatttggtttatttttctgcctgttttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaaaccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatcatttttctcatcagcactgtttttaacctaacaatccaaagccgagatcgtgaggtcttagtcttgaatgtgtaccagttaatgtattcaatttgaaagctcccttgtatctcaagagttctgcatttgtttccatggatacagcagcctatgctgctaaagcctttgtagatttgagttctgtgtttggctgaaacttcatagacattaagagctaccaagcttccagaatacataggactcattagagaaaacagtatttcacactttatagatcctgtcctccatttttttaaattctattacaccttttttaagacttctaaaaaccagccagccctaaatcacactttgaatgttgttgttattgtcttaatttctctttactattcaaatctcttataatttctgtgcttttattgtgcatagtataaaatacacaaaaataatgttcttataaccttaattattactttagggaggacctggcatttattgaacacttactatgtgctgggcattgtgctaagtacattttacatatttatccaaacatgataactccattttacaagggatgaaatagaggcttagaaaggttctgagttgttcaaggtcatctggataattaaatggcaggcagaggagcctccagtctttcttaatttttttagaaattaatttcatcaaataatggtcatggtacattttgaaaggacacagttcctttcttttctcaagagcttgtagatgaagactttccctcattgtcctaaggataacaaaattaaatgtaagaacaaaccaaacaaaatatctacgcttaccatccccgcaaaaagaaaagacaaaaacgtacctactcacacaaaatttaatctacatcactagctgtcaaagctctttggccgcatagtgcctgtcctgtaacatagttggtcacttaattataatattgtcttatagtcttaggttacttcttattgccttcttgttttattggcattattcttggcctcttcgtgaacaggggctgtattttaagcttttcttccctccccccaaatttgtctagtacaattttaagggcactgcaaagtcctgaaagtttaagattcatgcagacttagacttggctttgagttcttgccccttcactgatgaattctgtgatctttggcaagttctttaaccttttaaagcctcggtttcctcatctgtaacatgtatgttatagtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcaccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaatgcataggacaggctcctcaccacctgccaacagagaattatctaggccagaatgtcagtaatgctagggttaagaaatcctcctctagagaagcacagtgatcaaaataagatagaaaaggttcctcgactcataacatccatactttagtgagagaagacagacaataagctagtaacacataaatgaacctgataactgcagatgatattaaatgctgtgatgggaatcgggcaaggtactgtgatagtgactggggatgggggtgtttttgatacaaggaggccagggacggtttctttgagaggttatgtttgagttcagtcttacctacgtgactagatggtgccagttaaacagtcatcaggaagaagagcagtctaggcagagggaagagcaagttgtacaaatgtcctgaggaagggacaaacttggcctgttgaatgaacaggaaaaaaactctcatggccggagtatagtgactgaagggtagataggaagtgaggttggcaagatcctatggaagcaggggttctgcacacttaactgtcaagggccagagagtaaatatatcaggctttggaggccatatggtctgtctcagctactcaactctagtgtgaaagcagccctagacaatatataaatcaattggtgtggttgtatcccagtaaaactttatttacaaaaacagaagaggtgctgatgtggcctgtaggctgtactttgtggacccctaatgtatagtcttgtggaacatggtaagggatttggattttaaaatacaattggaaatcctggaggattttaaagcaagggagtgacatgaagtcatttacagtgtaaaaggttcactttagttgtcatgtgaacggtggatccacagtaaatttgaaacagccagctattcccatgtcctttcacatagtttgtgacagtcacatttctatcatttactacacatgctttgcacttctgcgtctctgagcctttgctcatactgttccctctgcctggaatgctctttcactgtcagtaaatgacacagctaagtgccacctccttttccctctgttcttttccctcggaaccactcttatgttggtgcaacattgggcctcttcattgtagcacttattttattcagtcttgtgataatattgttataagagctgccacttagtgttaatgtttcagatactcttttaaaagcttttcatacattttctcattaaatccttgcagcaactctgtgtggtggatattagccccattttccaggtgataaagtgatgatttataagactgcctcacttgactgagttcacacagctagaaagcagccaagtccagatttgaacccagagctccctgatagaagcccttagggattatgccctagttgtgttggtttcccccactagtctgtgagttccttgagggcaggggccatgtttaattcatttctatgccctgtgcctagtacagtgcctggcaaataataagtgctctataaatgtttattacattgacttagcttctaataatgtaccatctattacaagtgtgctatcttcaagaccactagatgtcactggagatgcataaatgtggttagagtttaatgtgactgagaagatgttaaaacagctcctggccattttaacaaaggaaaaatgagccattctttgaattatgaatctggtcatagcaatctgttttcaggtccttgaccatggttcccttgctttccagatgcagccttgcatcattttctcccttcagtgttatttgtgttctgggatgctactgctacagcttctagtactgctattttttctgtgttgtctgtagtagttaatttaatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattccatgggcttgacatacttgtaaaaaccaagctggataaattcccatgatgccgggctcctggtgtagtgtccaaggggtgataattcctcagtgcctcctccctgtgtgaaaacaagaataaagttaatcatgcagttcaaaagacaaatgctcgatcactgtgtaagtctccaccagctgtgtcacctgtgtaaccacagaggagaaatggaaaaggagtgacagggagagagccaggtaggtgagtgccagtcgtgacatacagaacaaaggaccgttttttttcccataccttcaaaaccctatggctgggccgggcatggtggctcacgcctgtaatcccagcatattgggaggccaaagcgggtggatcacacgaggtcaggaattcgagaccagcctggccaacatggtgaaaccctgtctctgctaaaaatacagaaattagctgggcgtggtggtgggtgcctgtagtcccagctactcaggaaactgaggcaggagatcgtgccactgcactccagcctgggcaacagagcgagactctgtctggaaaaacaaaaacaaaataaaaaaaaaacaaccctgtggctgtcttggttatattgttcctttaatattttgaatgtccacgagaaagcacagaggaaccttatactaagtatggagtgtgtgggggtggggtatacaggtgttcatgtggtgaggggtggtgaaatgttgttcttcaagaggtggaggcacagaaagatacttctatgatgtgaaaggaattgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaaaacatttcaatttcctattccaaagctgcaatatacaaactattaaatttctaatgttacccttgttggagagtgtcttataatatagtagcctctatttctgattctccaaaggaatggctctaaataaatgttcatatctttgtatagatattgatttctgtattatctatctgcagggtgttcctgaaaatgaaaggagaactaccaaagcagagagtgcttggcttttccggatgtggtacaactttgatcataagtatccttaattgagggaaaaaaaaaaaggataat

SEQ ID NO: 1129 - DNA, 110826 bp, mus musculus
cgtccctcgaaaatgggaatctctgcagaaattctctcttttagctccttgcgtccctcctccacagcccccgcctcctttcatccaccggtggctaagcgggggcgtgggtgtgcgcacccagggagagttgccctcgcagcggcgggggccagagcgctccgccagagccccaaactcttaacaagttcctggactccgcgcgcgcggagctctcgggcctctgcgcctctgtccctactaggggggctccggaggactggcggccgcggcgcagctgggctgagcggggccaggggctgtacccctccggcagtgcctgagtgcccagcggcggcgcgcgggtcagagctgggcagctgctggctggagtagcggccctgcccggctctccagcgtgaggatggcagcggcaggggcccggccctacctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcaggtaagtcccctcctctcatctcctccccggcggcctcgggctggcttgcccttcttctcagccgctgcctccccagcccggccggcttttctttattttccagtccacacccctccccgcgcgcactttattttccagtctatacaacccccccacctcgcccgcccgcccgcccgccgcgcacacacacactttcctgctgcagtggcgctcccagccacgaactcgctgggtcatccgttctccgttcctctggccagctgccgcgctgcaggcgtgcagctctggtctcagctcgcaggaggtgagatcaggagctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttagataaacttg

SEQ ID NO: 1130 - DNA, 38460 bp, mus musculus
tgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctggtgagcttgggatctgcgacaaaagggaccgagggtgaggcagagtgccccctaaagaagtcgggggacgggctcgtggcctgagagccggagctccttccgcccggcaggcccttcttgtacccgatgccagaaccagtcccaacactgcacctgttctttgcgctaaccgctttgccccctgccctcgtggttccttccaggtctttttgtgaaactccgatctttcctttcccatcctcccaggtctcgtcatcgtcccctacattgtgttaaatggcgaactttaggtgatttcttaagttatcttttcttctgctgtcccctcattttatcaaaacctgtcaccagcctttgttgaaggaataatgagagattgcttcccgtgggacattaacgttttgttgcttataactttagtattgacttgttcagtgaccccagtaggccaggtttaacccctgtcgcagctccttgccattctcttcaccatacttgttctcctttcttattttttacttttttaaaaatcgagacaaggtctcactctgtcacccaggctggagggcagtggcgcggtctctgctcactgcaacctctgcctcccaggctcacgtgatcctcccacctcagcctccctagtagctaggaccacaggtgcgtgtcaccacaccaggctaatttttagtatttttttgtagagacggggttttaccatgttgcccaggctggtctcgaattcctgggctcaagctatcctcctgcctcggccttccaaagtgttgggattacaggcgtgagccactgtgcccggccatcttcactatactctcttgctcctgtctctgcaagggatagaatttccactgcaagcccaaagtgtggacaagtattttaagaacacaggctttggagttaaactttacttgggatggaatccacccactttgtgagtttcggcaagtcattttagggagggtgtttcttcatctgtaaaatggagataaaaatacctgcctcaaaacagtttttagaaagatcaaatggcataatttatgtaacgtgtctaatactatcagtaccatgaactgaggagtataatgaggtcaatattctgctcctgtccctcttctcaatgtgtttagttatatagtagttgctcagtaaatggttcttccctttcctctttttttttctttttctttttttgagacggagttttgctcttgtcacccaggttggagcacaatggcacaatctcagctcactgcaacctccacctctggggtttaagtgattctcctgcctcagcctcctgagtagctgggattacaggcgcctgccactacgtccagctaatttttgtatttttgtagagacgggctttcaccacgttggccaggctagtctcgaactcctgacgtcaggtgatctgcccgcctcggcctcccaaagtgctgggacacaggtgtgagccaccgtgcctggccccctttcctctgttttgaattagcaacttaacatagtgaactgagctgggagatcagtgaacttaattctagtcctagctctgctgcttactagctccatttgttcacctcttcactcactcaacaaatatttattgagcatccgctactatgttccaggcactcctttaggcactggggatatggcaataagagtgagttgtgttaagttctatcgtgaccttgagtaaaatcaggctgaaccccagtttcctcctttggaaaatggtgataggaacacatcactgaattagtgagagtactaaatgagataatatatacattgtgcctactgtgacattgtcataggtgcttagtagtttttagtttctttcatttaaacttctccacccctcttctgtgaagctttccccagttaacttcagtggttctgatcactcattactcaatatgcaatccgcttccattcaacaaatgtttagtgaactcccacaatgagtaatgcactgtgctagttgctgtagggaatgcaaagggcctgcctctatggtgctaccagtcttaagttttagggataagacaagtatacaatgctaaaataaggcagtatgtaagagaaagttacacaaagaatattacagaaatttaaaggaaaatgctatcatgtccagttggggtgaccaagctacatggtggaagttatatttgaaaggacttcaaaggatgggtaggatttgaaattgcaagtgagtataagagctatcaataactgagcacctgctacatgccaggtattgtgctagacatcctctgcgtatttgctactaaactttacagcaatcatttcagttaggtggcttttaactacattttatgtgcagatgaggatatgacatgcagggaggtttgatgatttccctagggtctacatccagttagtgccatgcatgaaatttgaacctagatctgactctgaagcccagacttatatatccatttatatataagtggatatatccattcatatatatatagaagcgcagacttatatatatccatttgtgctacacagcctcttgtgaacaaaggcacagaagttggaaggtgctagtatatttatagaacaacactttggctgaagcacagagaattattaggagataagccttcagaggtaagcctactgagttagggaggcagtatggaacagtggtggtttggaatgtgtactctggagtcagcttgcttaggtttgattctaagcactgtcacttaactagtgggatattggggaaattaccaaacccctccttgcctcagtttccccatctgtaaaatagagatataacaatacttagttcatagggttattaggtggaatgagttaacacattggataaattaacacacttaatagaatgcctggcatataataatgcaatgtgttatttcttattattggctactaacctgggaggcttaatgggctacaaagagccagtggaaatttttgaggagggaagaatttgaaatcatgaattggacaacataatagagggtaagttacagtgggggaatatctggaatctagagggccagtgaagctgttacagtagttctgagaagaaatgataaggatctggacaacagcagtggcaggagacaagaggatttgagacaaggcagaatccacgagggtttgtagcgtgtgaaggaggatttgtcttagatcagtattttccaaactttagtgtgctagcagtcatctggggaatcttgttaatttgcaggttctgattcagttggtctgggatagggcccgagattttgcatttcttacagactccctggagatgctgctgctgctgctcccagtaccacattttgaagagcatggctatagacacccaagagtatagtgacactctgaacaaaaatagataatatataaggagggttagctggatgagggccttaaaagttgactaattcagtttgggacatgtttagtttgagatactggcaggccattcaatagatatccaacaggcagttggactttaaaacatgcacttcagggcgcagaagaggtcttgcctagagttgttgatttaggagtcatctgcacagggttaaaaagacagaatcttgggtaatgcctgtatttagggggcaggaagaagagataggctgtaataatggctgcagtctggggtcttttttttttttttgagccggagttttgctcttgttgcccagggttggagtgcaatggtgccacctcggctcactgcaacctctgcctcccaggttcaagtgattctcctgcctcagcctccccaagtagctgggatcacaggcatgcaccaccatgtgcagcaaatttttgtatttttagtagagacagggtttcacagtgttggccaggctggtcttgaactatagtctgggatctttggaagatctcaggctatgaggaagctggccccaggtgaaggggctggctggagaccatgccactggctaccccgtcatccactcctgggagccaggcctctttgagctgattcctgcttcatgcttccccgtgttgattcctttttccaggattttggtcaatagtataacccatttgctcccagctattttttttagggttgcagtccctgcttttattgtgtgttttttggccctgcctctacctgttccccttactggcccaagccaggcagagcaatgttcatgtgtgtttctgtgagcacatctatatatgtgcaagagcctgcctgctgatgggaaaggggagggacatggatccaagtcgcctttcccgctgagggctagacagagagcagggtccattagctgaggtcctggaagtcctgtcttttatacatggagctggagggccatagttcctgactcagctcatggaacactgttgctgattcttgaagagacaaaggggagagagtaggggatcacatgggacttcagtgactacagagacttctgataccaactacctggagttaggccaaactgcacaggttaaaagcacagtcctctacaagactgctcttcagacaccagccacaattttgggggttcccaggaccatcctcacttcagagcaagtagcaacaaattcacgggttcccacgttccgctcaggtttatttcttttttggcacaatctcagctcactgcagcctctgccttagcctcctgagtatctgggactacaggtacatgccaccatgcccggctaacttttgtattttgggtagagacggggtttcaccctgttggccaggctggtctcgaactcctgacctcaagttatccgcccatcttggcctcccaaattgctgggattacaggcgtgagccacggcacctggccctcccctcaggtttcataattcactagaatgactcataggactcagaacagcactctacttaaaattacagttttattatagcaaagggatacaaatccaaatgtgcaaaagagagagatacacagggcgaggtctgacagggtcccaaacacaaagattccttgtcttgtccctgtggattcaagacatgttaccctcctggtttgctggtatgtgacaatatgcagagtattgccaatcagggaagttcactcatgtgtctatagtttttattggggtttcattatgattaattggaccattgctcacataatggaactcaatctccagggtcccaccactcccgaaagtttgggcttatatgttgtgacttaaagccccaaacctctagtcatatgtgcggtgtttctgacgtggttagcccccatcctgagtcatcaccagagtacaaactacgtaagggcctactgtgactcacctgtaagcataaactaccagagcccctgtgaatatcaaaaatactcctctgtcattcaggaaattctaagtttagaggctaactctcaagtacaggggacaaaggccagctaaattctttattatacagtagtgacagaactggaattgactccatgggaatcttgaacttgagctaacatttatccagcccctattgtgttcctgtattaatacatttcttcctcacaataaccctgtgatgatggtaccattatctcaattttacagaggaggaaactgaagcacagagaggctaagtaacctgctcagtgtcacatggatagtacaagatggaactgggatttgaactcaggctatttggcctgcactcttaaccagtattctccaaataccatgttgagcattgagtatgtgctaggtgctgtgcagtgttatttatctttatagcagtattgtttccatgtgagatccctgtttgactttaaagcctgtttttttcctactgtactacaatgcttctcctagcagtagcaggcaacagggaaactgaaaacaagcaatcctggcacttgaaagggcagtgttatagtagtgaggagaaaatatggcttcaaaaagtgttggttttggctgggcatggtgcctcacgcctgtaatcccagcattttgtgaggccaaggcgggcggatcacttgaggtcaggagtttgagaccagcctggccaacatggcaaaaccctgtctctactaaaaatacaaaaattacccgggcatggtggtgggtgcctgtaatcccaactactaggggggctgagacaggagactcgcttgaatccaggaaacagaggttgcagtgagccgagatcacgccactgcactccagcctgggtgacagagcaagactgtctcaaaacaaaccaaatgggttggtttacgcattacatgctgcagagtattcaaagagagtgaggcttgaatgcagatccttgtatttcttgattatgtgaggctacttttggagagcacaatgtcagtaaagtggtgagaaggccaatgccagattacagaggattaagtgcgaaagtaaagtttgatcaagcaagagaaggagagtagtttgagagaatggcagaaacaagggagtgatgtatttttaaattttattacagaagctttcaaatgtgtaaataaaatgaagagtagcataatgaacctcatatacctatcaacattctattattttattggtctcaccacattttttttggcctttttatttaaaactaattttaggcatatagaaaagtgcaaaaatagtagagagagtgcctgtattcccttcgcccagattcctctaatgctaacgttgtacataagcatagtacactgataagaaccaagaaattaacattagtaaaacactattacctatagaccatatttgaattttagcaggttttccacttatggccttttttgttccaagatcttatctaggatcccacattgcatttagttgttatttttccttcatttcttccagtctgtaatggttcttcagtcttttcttatctttcataatcttttctgagtattttaaagcaaagcccagacatatcatcttcatttgtaaatacttccctacgtttctctaacaggtaaggactttttctttgttatcatacataacaaaactaataataactgcactccagcctgggcaacagagtgagactccatttcaaaaaaaaaaagaaaaggtaaattggatccccatatacaccttcaacaattatctacttacgatgaatcttctttcttctacagccctacctactttctttattattttgaagcaaatcccaggcatcattacattagtaaatatttggtatgtatctctaaaagataaggattctggctgggcacggtggctcatacctgtaatcccagcactttgggaggccgagatgggcagattgcttgagcccagaggttcgagatcagcctgggcaacatgacaaaaccctgtctctactaaaaatttaaagagtagcctggtgtggtggcacatgcttacagtcccagctacttgaaaggctgagatgggaggattgcttgagcctgggagattgaggctgctgtgagctatgatcatgttattgcaatcctgcctatatgacagagcaagaccttgtctctaaaaaaaaacaataaataaataaataagaaatttttttttgattttgtattattttagagttgccttcttgctatgttgcccaggctggagtgcagtggctgttcacagtcgtgatcatagcacccgcagccttcaacttctggcctgaagggacactctcacctcagtctcccaactagctggaactataggtgtgtgccacagttcccaaattagaattctgcttttaaagagaacataaccacaataacattaatgcatgtaaaaaattaataacttcttaatatatctcagggttcaaatttccaattatctcctaaattatatttttataatttaaaaattggcccactgcctgtttttctaagtatagttttctgggaacagagctacacttatttatttatgtgttatctttagctgctttcatgctacaatggcagagttcagcagttgcaacagaaaccatatggctctcaaaacctgaaatatttactgtttgaccctttacagaaagtttggtgacccctgctttaggcaattatcttttagaataattaaaaataggaagaaatgtcatatttactttcattttaactaatttgggagatcatttatttatgtaaatccaagtttccttctgatatcatattccttcttccagaggaacttcctttagcatttcttgtagaatatattttagcttttgcttgtctgaaaaacgtttttactttgactttatttttaatagttattgctgggtttagaattcagtgttgatagttttattcttttagcactctaaaagtgtccctccattttcttttggtttgcatagtttctggtgagatgtctttctttgtttatttgtttgtttatattttgttagagatgtctattataatttttttttttttttgagatggagtctcgccctgtcacttaggctggaatgctgtggcatggtcttggctcactgcaacctccgcctcctgagttcaagctattctcctgtctcagcctcccaagtagctgggattacaggcacctgccaccatgcccagctaattttttgtatttttagtagagatggggtttcaccatgttggccaggctggtcttgaactcctgatctcaggtgatccacctgcctcggcctcccaaagtgctcagattacaggcgtgagccaccatgccggccttttattgtgattcttatctttgttcctgtaaatgcaatgcctttctctttggctactttcaagattttctctttatctttggttttcaatagtttgtgtctaggtttgtggattttttcattttgtcctttggtattcatcttgattggggttctcttggcttgtatctgtcatttgatgtctcattatttttggaaaattctcagctattctttttttttttttttgagacagagtctcactctggagttcagtggcgtgatcttgggctctgcaagcctcgacctcctgggctcaggtgatcctcccaccatagccttctgagtagctgggactagaggtgtgtgccaccactcctggctaatttttaaatatttttttgtagagatggggtttcgccatgttgcccaggctggtctggaactccctggctcaagcaatctgtctgccttggcctcccaaagtgctaggattacaggcatcagccactgcggttagcctatatctcttcagagccattatctttctattcttctgggattccaattatttacataataagaccatttaatgttttcccatagttcctagatactctattcttttttcttttcttcttttactcttctccttttgttttagtttgcataattttgactgacctagctctgaattctttctttggtattgaggtaactgataaggctggcaaaggcattctttatctgttactatgttcatgtatttctagcattgccatctgattcttacagtttccatctctttgcagaaattcatcatcattcatgcatgtaccttttctactagagccttttgcatattaaacatagtaatcttaaatttcttttctgataattctaacatcttggtcatctcagagcctggttttgttaattgctttgtctcatagtgggttgttttttcatgtgagtatgggggagataatttgttattgatattgaacgctggacatcatgtacacactgctagaagtggcacatctctgctgctgagttgtcagtcagtaggggttaagtcagtctagtcagggttgagctttgtttgttttgttgttgttgttgttgctatggttaccttcagtgcatcaccagcttcagattcctctgttgttaccttgagtttaggggtgggggtgctatgttgtcccagtgttttgttttttgttgttgtttttttttttttgagacagcatctcactctgttgcccaggctggattgcaatggcgtgatcatatcttactgcagccttgacctcctgggctcaagtgatcctcccactttagcctcctcagtagctgggaccacagttagttgcatgccaccatgcccaactaattttttaaaaacattttttgtagagatgggggtctcactgtgttacccagactagtctcaaactcctagcatcaagcgattctcctacctcagctacccagagttggggttacaggcatgagccactgcacccagccccaatgtttttattaatgttcatgttctgtactcagcttctgtctttgcccttgcatctcatggtgagtctctttctaagctctagcacttcctccagcagtagactgctgttgtttattactccatacttgctagcctggtgataggggccagggaaaggggattctttgttttcatagtctagtctctgccttaggcagaccatgtgtccctgggtctcctgggtagcactttcttagtgatcctgtccccctcctagctgaaggaaactcttaatggtctgggcccaggatggttttctgtccatcccttagtagtagagagcttttccttttccctttctccagcttcagtgagttgtcacctgtgttctgaaggcaacttgtttttgtctaagtggctttaaggctctttcctctaggggcttttttctagagaagagcctgtaagtgggtgtgaactccccttgcgtctattgcttccagggattctgtactcttgtgctgatccatacttggactttagcaatttatttaaaattttatttgaattcttacccatctgtgtggtgtggtgtgcagcattgtcttcccctcatgctttgctactgttgagccagtgctgatgtctcttcgtggaagcacctggctttctttagatttcatccaggctacttggtctccctacaactcagttctcagatgaattcagggaaagttatgattcagtaaagtatctagccttttctcattattctacttggggaatggtctttccagcttcctatatcttaatcagaagtcaaattacagtgttatatagtcacttgaaataggtgctatctttgtggttgtgtgtttatttcaatacatggtagtttcattggtttaattttttctctcagtttcagggattgcttccttcaaattttaattttgtttaataattgtgtgaagtgtttatatgattgcaagtcatttatatggacaacatatattgaaaaaagcctagtttctctccctgtctgctctatcctattcctttctttcctctataagaaacctttaaaaaaaaattctatggcatgtttcttatatttaagaaatatgagtgtggttaagaaattgtttttgttttattttattttattttattttatattttatattttatttattttatttatttatttatttgtttattttttgtatttttttgtattttattttattataacggagttttgttcttgttgcccaggctggagtgcaatggcgtgatctcggctcaccgcaaccttcacctcccgggttcaagcgattctcctgcctcagcctcccgagtagctgggattacaggcatgcgccaccacgcgcagctaattttgtatttttagtagagatgggatttctccatgttggtcaggctggtctcaaactcccgacctcaggtgatctgcccgcctcggcctcccaaagtgctgggattacgggcatgagccaccatgcccagccttttacaaattctttgaacatcctcattccttctaaaatttcagtatactgtctgcatttcatttatctgcaactgttgcccattaaaaattgtgcctactgggccaaaaactgtatgagaagtcattgcctctattttcttaggaatttgtagatttgagttttggttgtaataaaatttgacggatgtgaacatcctcattctttctaaaatttcagtatactgtcttgtgtttcctttatctgcaactgttgcccactaaaaattgtgcctactggcccaaaaactgtatgagaaggcattgcctctattttcttaggaatttgtagatttgagtttcggttgtaataacatttggcagatgactatgaatttaaaagttcacattctttattcactttgaaaattttatttgctctgtgattgccaggtaacctgtaaagactgtaatcaaggtatattttgctatttccctgtttcccgcacttgcctttatggttcatgtaatgctcatttttagccagcagaggccactagagcctgttagggagcagaagtgcaacagaaacgtggccattctaagacagtgattgctaaaaggtcactttttaataactttacaattattatctcagtcttgctagcttgtgccatgtgaagattttatgctaaatgttggtgggcaagaaggtgtctatgacatttactttagttttttcattatgtttaatctttaaagaaataaatttgaggattattgttaactgcattgtgtaatgtctgttgagctaacacctactttcctatgtaaaaccctacaaaatacatggtcccaactctctaggaaatgatgatatatatgaggaatgctacagtttattacaggcttactttttttcccctgactcttctcagtttgcaggcctttcagatatatccatctcacaagacatccccgtagaaggagaaatcaccattcctatgagatctcgcatccgggagtttgacagctccacattaaatgaatctgttcgcaataccatcgtaagttagactagttgagagaacttctgttcagtatcatgggactaagtaactaatagtactttgcaatattttcatttggttcactgattttgaatatattttatatactgaagtttaatattttatcctagagattaatttggtacagcctttttggagagcagtttggttataatgcatattaataatcttaaaacagcaaggtgcggtggctcgcgcctgtaatctcagccctttgggaggccaaggcaggcggatcacctgagctcaggagttcgagaccaacctggcccagatggtgaaacccccatctctactaaaaatacaaagattagccagacatggtggcatatgcctgaaatcccagctgcttgggagactgaatcgcttgtctccgggaggctgaggttgcagtgagccgagatcgcaccactgcactctggcctgggcgacagagcaagactccatctcaaaaaacaaaaaaaaggtcttaaaatgtccaaatctttttaaaccaatatattatcatacttctccaaatgtagtataaggaaagttttaaaatgtaaaacaaaaattttcaacattaaagtatcaatatacaaagatgtttattatagcattctttgtaataggggaaagctagaaataaatgaaccacagatgaggtattggttaggtaaattatgttatatctttgtggtgggatgctaagcaactattataaattatgtttacaaagtgtttaataacgggtaaaattctaggtgaaaaaattaaaacagaattagctcagtggtgctttgagaggttgtatttgtattactgaacccttcttccagtttcttgattttttttttttttttgtatctggcatctaggattcatttaccaattaaattgggaatgttaaaaatttatttcatatattgcaaagaatgtagtagctagagagcaggctaattggtccttggaacctcatcttctatgaactgaatgtcacatactgtgttttgtagagcagctttttatagtacaattgttttagtttctttaagcagcctattgggagggctgtgtttcttttttatggattttttcaacatcaaaacagaacagatcaaaacagatgtggaaaggtgttaaaagttggcttaagaagttaatagaaaaagcataccctacctctctggtttgtttgtgtagtgaaggagttgaactggaattatctgcaaaattcagtgaagagttcacaggagattgaaatgaaagaaattttagcaaattaagtaaggctgctggcaaccttggtcatcacaatacaacaagttgtttctgtctttcagatgcgtgatctaaaagctgttgggaaaaaattcatgcatgttttgtacccaaggaaaagtaatactcttttgagagattgtaagtatatgaggtttttaagggtttgcttaatctatctcactgtaccttatcgtaagtactttataaggcaaagtctctgtggtaataaaactgacatcattttgtaggataaaaaaatatgtaaacgaatatgtaaatcaaacttctggcagaaattaaaaattgattttattttatttttattttcatttttttttgagacagagtctcactctgacttccaggctggagtgcaatggtatgatcttggctcactgcaacctccgcctcctgtgttcaagtaattttcatgcctcagcctcctgagtagctgggattaaaggcgcccaccaccatgcccagctaatttttttgtatttttagtagagacggatttcaccaggttggccaggctggtttccaactcccgatctcaggtgatccacccacctcggcctcccaaagtgctaggattacaggcagacattaaaaatttagattggaatctcagagattgaaacattttgcttattatattgtcctcatcagtaaatgtacactggccaggcatggtggctcatacatgtaataccagcactttgggaggccgaggcaggagaattgtttgaactcaggagtttgagaccagcctgggcaacatggcgagacctcatttctactaaaaataaaaaaactagccaggcctggtagcacaagcctgtagtcctagctacttgggaggctgaggtgggaggattgcttgagtccaggagatcaaggctgtagtgccgtgactgtgccactgcaccctagcctgggtgacagagtgagacctgtctcaaaaaaaaaaaaatatatatatatatatatatatattttaaaaaatgctctagtggttactacaaaatacatttctggaggctgctaatttacaatatttacatttattacataatattcctggaagctgctgacacataaagagttaatgatctccaagggaaaggcaaatgtttaaatttttgtttgttagttttttgagatggagtctcgctctgttgcccaggctggagtgcaatggcacaatctcagcttactgcaacctctgcctccagggttcaggagattcttctgcctcagcctctggaacagctgggattacaggtgccccaccaccacatccagctaatttttgtgttgttagtagagacgggttttgccatgttggccaggctggtctcgaactgctgacctgaagtgatccacctgccttggcctcccagagtgctgggattacaggcaagagccaccaccccggcctaaatgttaaattaatatgatagtaaatacccgtaaacatttaacaaattaatagtacctttattgacagtttgattttcaagcctatcatttagtctgatgactgctttctttattagagttctgtcaaaacagacagcgtctcattctgttacccaggctcaaatgcaatggcgtaatcatagctcactgcagtctcaaactcctgggctcaagcagtccttctgccagtctcctgagtagctgggactgtaggcacacatggctagtttttaaatattttgtagagatgggggtctccctatgttgcccaggcttgtctaaaactcctggccttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaataaaaaaaataaaaaaataaaactcctggcctcaagcagtctgcccacctcagcctcctaaagtgctgggattacaggcaagagccactgcccagccaatgttttattttttcaactttttgttaaaaactaagacaaaagcacacactttggtctaggccttcacagggtcagaattggatcattagtacaattgtcttccacctctgtatctgtcctattggaaggtcttctggggcattaacacgcatgaaactgccatctttgatgataacaatgccttcttctggaatatctactgaaggacctgcctgagactgtgttatggttgactttttttttttttagagacatgatcttgttctgtcactcaggctggaatgcagtggtgtgattatagctcactgtggcctcaaacttctaggctcaagccattctcccacctcaggctcccatgcccggagcctgtgccaccatgcccagctaatttttaaatttttttgtctgggcacgatggctcatgcttctaatcccagcgctttggcaggccgaggtgggtggaacacctgaggtcaggagttccaggctagcctggccaacatggtgaaaccctgtctcattacaaatacaaaaattagctaagcgtggtggcaggcgcctgtagtcccagctactccggaggctgaggcggaagaatcgcttgaacccgggaggtggaggttgcagtgagccaagattgcaccattgcactccagcctgggtgaaaagagggaaactctgtctcaaaaaaacaaaaaacaaaaaacaaaccacatttttttagagacagggtcttgctatgttacccaggctgaactttttaagtagaagtatactccaacataacaatgaaaagtataatatagtaaacacgtaaaccacagtaacatagtcattttttgtcattatcaagtagagtattatgtagtgtacataattgttctatatttttatatgactgtcaacatactaggtttgtttataccagcatcaccacagacacgtgagtaatgtgttgtactagatgtcactaggtgataggaatttttcagctccattataattttatgggaccactatcattgaccgaaatatcattatgtggcacatgacagtacacttgaattcagtttttaagttgagcagttaaaaaaaaattaatgaaattagcagcagttttattagaagtggtaggattatggttttttatgtcttttccaaactttccacaatggtgtcaaaattacttatacaattaaaaaataaacaatattaagtatataaatttgcgtacctctcttgggtaaggttatatacatgtgaggttaaagttcgatgtggaatatttgcctttttggaatgaattgaggaaggtaattgtgctctaagctatgtgctactgaactgttggcatgcaaatcactcagcagctttttttgtttgtttttttgagacagagtcttgctctgtcacccaggctggagtgtagtgagtggaggttgcgatcttggctcactgcaacctctgcctcctgggtttaagggattctcctgcctcagcctccctagtaggtgagattacaggtatgtgccaccacacctggctaatttttttgtatttttagttagagacgggatttcaccatgttggccaggctcatctcaaactcctgaccttaagtgatcttcccgcctcagcttcccaaagtgctgggattacaggcatgagctaccgaacccgaccaaatcactcagcagctgtttttgtttgtttgtttgtttgtttttgagacggagtcttgcactgtcacccaggctggagtgcagtggcacaatcttggctcactgcaacctctgccacccgggttcaagcaattcccatgcctcagcctcccaagtagctgggattacaggcacgtgccaccatgcccagcgaatattttgtatttaatagagatgggatttcatcatgttgcccaggcaggtctcaaactcctgagctcaggccatccgcccgcctcggcctcccaaagtgctaggattacaggcgtgagccacagcatccagcctgcagcttttgattgaggaccatgtttgctagacctgatgttggcagagcctgcagagccttttgcagttttcagaaagctttcatatgttattaaagtttaaccttgtgaaattaccaatactgggctgttttttcacctagaagaatagcaactctatattaattcaatatactaattataaaagggaagcagtatgacagagtggcaagaactttggtctaagaatcaaaagaccaggctgggtgtggtggcttatgcctgtaatcccagcactttgcgaggctgaggcaggtggatcgcttgaggccaggagtttgagaccagcctgggcaacatggtgaaactccatctgtacaaaaaataaaagttagctgggtgtggtggcgtgtgcctgtagtcccaattattcaggaggctgaggtaggaggatcacctgagcctgggaggttgaggctgcagtgagccatgatcgcaccactgcactctagcctgggcaacagagtgagaccctgtttcaaaaaaaaaaaaaaaagaaaagaatcaggccaggtgcggtggctcacgcctgtaaccccagcactttgggaggccaaggtaggcagatcacctgaggtcagttcgaaatcatgctggccaacatggtgaaaccccgtctctactaaaaacacaaaaattagccaagtatgatagcgggtgcctgtaatcccagctactcgggaggctgaggcaggagaattgcttgaacccaggaggcagaggatgctatgagctgagattgcgccattgcactccagcctgggcaacaaaagccaaactccatctcaaaaaaaaaaaaaaaaatcaatagccctaggttctggtcccacctccacatataaagctaggcaagtcatttccttctcagcttcattttttgtatttgtgaactgagcatgattatacttgccttgtctaatgcagtctctgactggtaaagtgccttggctatagtctttttttcttagaatatggggtagggaacctaggtctgctgattgtttgtccattggtctttaattatagcgtgccagcatgtgtcttagtagatggggagaaggaaagggtgatttgtgggatatgaaataagcgaaactggaagtctatgtaaagaagtgcattcaggattaggggacagggagggcaggtggtgggagaggagaggtaggaaggcttggccagccaaagagagccttgatgtctgaattctaggagggagagaggtagatattagaataaagacagaaaatattaccttcgcttctgtcttttcttgtcttgtaggggatttgtggggccctttgatcctttgtgtgacactcgcattgtaagtacttgcattttctttctttgtcatttgagctagactagacttttttgtggatttccaaaattgtgggggattttgattgaatatttcatttaggacttatatgacatgttgtacatgttatactccttaggtatttaagcctctaaagtcactttccaaatcaattaaaatatgatgaaattaggctcaccttccttaaccaatgacattttagtctgttttagccatgtctattcaacaaacatttatttacttatttactctcctgttcctccctattattaaactaagtgaattaaggtttaagcaccctttgtttgcaaacataattctctgtaatcttactaaaaatatgaatgagaatgagaataaattaggagagttaaaagcaagatcatgtttcagagtgttgtacttttccatacacattgtaggtaaaggaagaggacggggaaggagaagaaggttacactagagagatgaatataaccattgatagagcgggaaaaaatactgccctggaattcagttctgagttcgcattctgactctgctgtcagctagctatgtgactttgggctactaataaccaatgtttgtataatttttcccagtttgcagaaaactttaaaatactttctcttattttaacctcattgcaataattaaaattattttatttttctttttttttttgacaaacaagctcaggttcaaaaaggttgaggatttaaccaagatcacataatcagtggtagacctgagattcaacctcaggtttcctcactacctattttgtacctctagggttcattacacatctcttcccacctggtcactctgggtcgcctcttccatatctgtaaagggagtggttgagggtcctttccaggcttaaccctttatgggtctaaattcactaagtttcttgctgacctctctaattttttaaatttaaattgagcatatattaatttaggtaataatgtagagtactatttcttatgcttttagtaaccatgttaagggatgcagcctaatgccttgatggaggggtttatattagatgtcccgagcatatatattttttttacttttgaaagtttaaccttatagattatgtagtttaaccccacttagttgcagagaaaactggagtcccaggacatcaagtgacatatctagtgacagaattaggatcagtatctgggtctcttgccttccaggctagttaatattctttccatcataccatgctgaagcaacagggattccagacaacaagtgatgagtgctggccattctttgcatctggttgtcacgacttggaatggaatatgcatatcatagaatacaaaagcctgtgcatactgccaagtagcatagcagggcaagaaagacttacagtgtgacttctctatactgtttaataagaagaggttgtgagcttacagttattatttttcttggtaataacaccaagtccaaatattcaaaacagtttatatctgtaaaattcttagacaaagaaaggatatttaagtggttgttcaactactcaattccaaagcaaaaccctttagtaataatctgtatgttttgattttttaaaaatcaacaactaaaaaggtttatagactgtttccatttttatttattatttttattttgttttgaggcagtctcactcagttacccaggctgagttggtggtgtgattacagctcactgcagcctcaacctcccaggctcaagcgattctcccaactcagcctttctagtagctaggactataggcgtgtaccaccatggccaactaattttttattttttgtagagacgggggtttcgtcatgttgcccaggctggtatcgaactcctggcctcaagcgatctgcctgtcgtggcctcccaaagtgctgagattacaggctaagccaccatacctggcctatttccatttttaaatatctcaactgaaatcttaacccaagaactacaaattctgatgtgtctaaaggctagaatagtaacctaaatgcatgtagtagtgatatggtgactgtaagccccttgtacttatgtcagttacacttgattgttgcagtgttggaatgcaggctcaatgttagaaagtctaacagttttttcaagaaaatctagaaattcatattcttatgtgaaataaaatagtgtcaacttaaattcaaaatcatcttaaatattatataagcccaaggcctcattatatatgagccacatttgacccttcagtttataacctctgcttaaaaaaaaggtcttcaataattcatttaaacatttcaacaaggtcaaatggagcaccccttgtagtcctgaggcatttggaatttgcagtaagggagccttgccaaatgcttgtgtcattttccttttagcacaacctacatattacagatcttcaggtgaggtatggcacagcaatctgattcaaagtttgagaacccatgccttaactttgttgccctaagtaaaagattaagcaattcttacgctgtttccttttctcagaatgctgcaaagagactctgcagatagtgaaaaagatggagggccccaatttgcagaggtgtttgtcattgtctggtttggtgcagttaccatcaccctcaactcaaaacttcttggagggaacatgtgagtattattaaaatgcattctttttttcctcttgccaggtagtatatcttagattaaggaatacaggctagctagatttttttttttttttgagacagggtgtcactctgtcacccaggctcgagtgcattggtgtgatcatggcttactgcagcctctatctcccaggctcagcgtcccaagtagctgggatcctcctgccccagcatcccgagtagctgggactacaggcatgtgctactatgcctggctaattaaaaaaatttttttttttgtagagatggggtcccactgtattgcctaggctggttttgaactcctgggttcaagtgatcctcccaccttggcctcccaaaatgctgggattacaggcatgagccaccatacctggcctcatattttgttttaaagaaaaatcaaactaaataagggccaaagagaagtgttcttaaaaccactaccactgtacagagataaccttgttaagttaaattatcttaaattatcagaggtcctttgataagcttcagatgccctttccaggccctgaaatcataggcagacttttttgtgtaagaagagtatgtacgttttggggggcaagtggtccctagcttttaacaaattctcaagtataataggtctataaactagaaaggattaagaaccactaccttagaggttcagagaaagatatctgtaggaactagagcagatcatctggtgttagatgattgacttttaaggaatttgagaggagaggaggaagagtatggggaaagaaaattaaagcatgtacttaattttttttttttttgagatggagtctcgctctgtccaggctggagtgcagtggcacaagctcagctcactgcaacctccacctcccaggttcaagcgattttcctgcctcagcctcctgagtagctgggattacaggtgcctgccacaatgcccggctaatttttttttgtatttttagtagagacggggtttcaccatgttggccaggctggtcttgaacttctgacctcaggtgatccacccccccacccttggcctcccaaagtgttggtattacaggcgtgagccatcgcgcccagccaaaagcatgtacttaataattaatgttaggatgtagatgttatgtaccaagaaggaggcaacattccgttacatagagaaatctatgtaataagctgtgtcataacacccatcagttgtatttatgatctttattaatgtattttgtttttaagatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttggtaagtatgtacttatttccacaataacagaacagacaaaaacatgatttaatgatgaagaccagatgaggagcagtataagtccaaagttagatgtgagtgatatgattcttgatagtattatccatagaaccctcttccctgagtaggcaatgatggggcttatctgagttggatatctggacttataagatgtggagagtcacatcttttttctttctttaaaaaaaaaaaaaggttgggaaagtggattacactacatttagcctagtcctggtatatacaaggcattaggtgacttgtggaatgactgggatcttttcctgataaactaattaaaataaaaataataacatttacagattgcttatcaaaggccaggcactgtttaagtgctttatatatattatcccatttaagcctcacagcaactctaatagagaaatactgttattagtcccatcttacagatgaagaacagttacagagaagttgagcagcttgccctaggttgcattacttgtgagtaagagagtcaaattgcaaaccaggcagtcatgaacctttaagaactatactataccaccttccagtgtagattgtaagtatcattatatagcacttttctgcttcagtagaacattttgctaaagactaggaagggcctatagcaatgataatgaatgctatgtgctcattgtttttatattcctaaagttctcttaagattccagcttaaatttagaagtgttcactagcttctgctttaatggataggcagactgcttaatatttttaagtgtagtaacatctcattgctctggaacatggttgaaagctaagaagtaatccaacaaaggtctgagagagccagaactgatattccaaagactgtatattaagcttgggtgcttttcccatggggagagcccctcattctctcactgagaatctcataattaccataaatgtaattatacttacttagttatccagtgtccaggctcacaggtgatcacgaagtagaatcataggagagagaaactttaattcagcaaacattaatcacaaactatgcgtcaggcataattttaggcatggtctttgtccttggagttcacaatctaacagagcagcccgacgtgaaaacatttaaaggcaataggtgttctaagtgggaaatggagatttatacacagtacagtgggacagacatgattattcaggaaagatttcccagagatgtgatgatgatgatgattagtatttgagacagagtctcactctgtcacccaggctggagtgcagtggcactatctcggctcactgtaacctccacctcctggattcaagcagttctcctgcctcagcctcccgagtagctgggattacagctatgtgccaccacatccgattaatgtttgtgtttttagtagagatggggtttcaccatgttggccaggctggtctcgaactcctgacctcaggtgatccacccgccttggcctctcaaagtgctgggattacagacatgagccaccgcacctggctgattattttcatttatttatttatttggctaaaaatatatatatatatatatgtttttatattattattatactttaagttctgggatacatgtgcagaacatgcaggtttgttacataggtatacacatgccatggtggtttgctgcacccatcaacccatcatctacattaggtatttctcctaatgctattcctcccctagcccccccagcctctgacaggccccagtgtgtgatgtacccctccctgtgtccatgtgttctcattgttcaacccccacttatgagtgagaacatgtggtgtttggttttctgttcctgtggtagtttgctgagaatgatggttttcagcttcatacaaaggatatgaactcaaccttttacgtggctgcatagtattccatggtgtatatgtgccacattttctttatccagtctatcattgatgggcatttgggttggttccaagtctttgctattgtgaacagtgcagcagtaaacataggtgtgcatgtgtctttatagtattacccagtaatgggattgatgggtcaaatggtatttctggttctagatccttgaagaatcgccacactgtcttccacaatgcttgaactaatttacactcccaccaacagtgtaaaaatatttctatttcttcacatcctctccagcatctgttgtttcctgactttttaatgatagccattctaactggcgtgagatggtatctcattgtggttttgatttgcatttctctcatgagcagtgatgatgagcttttattcatatgtttgttggccgcataaatgtcttctcttgagaagtgtctgttcatatccttcgcccactttttgatggggttgtctttttcttgtaaatttgtttaggttctttgtagattctggatattagccctttgtcagatggatagattgcaaaaattttttcccattctgtaggttgcctattcactctgatgatagtttcttttgctgtgcagaagctctttagtttaattagatcccatttgtcagttttggcttttgttgctattgcttttggtgttttagtcatgaagtctttgcctatgcctatgtcctaaatggtactatctaggttttcttgtagggtttttatggttttaggtgttacatttaagtctttaatccatcttgagttaatttttgtataaggtataaggaaagggtccagtttcagttttctgcatatggctagccagttttcccaacaccatttattaactagggaatcctttccccattgctggtttttatcaggcttgtcaaagatcagatgattttggatgggaggcattatttctgaggcctctgttctgttccatcggtctatatatctgttttggtaccagtactgtgctgttttggttaccatagccttgtagtatagttggaggtcagatagagtgataactccagctttgttctttttgtttaggattgtcttggctatatgggctcttttttggttccatatgaaatttaaagtagttttttctacttctgtgaagaaagtcaatggtagcttgacggggatagcattgaatctgtaaattactttgggcagtatggccattttcatgatattgattcttcctatccatcagcatggaatgtttttccatttgtttgtgttctctcttatgtccttgagcagtggtttgtagttctccttgaagaggtccttcatatcccttgtaagttggattcctaggtattttattctctttgtagcaattgtgaatgggagttcactcatgatttggctctctgtctgttattggtatataggaaggcttgtgatttttgcacattgattttgtatcctgagactttgctgaagttgcttatcagcttaaggagattatgggctgagacgatggggttttctaaatatacaatcatgtcatctgcaaacagagacaatttgacttcctgtctttctatttgaataccctttatttctttctcttgcctgatttccctggccagactttatgttgaataggagtggtaagagagggtatccttgtcttgtgctggttttcaaggggaatgcttccagcttttgcccattaagtatgatattggctatgggtttgtcataaatagctcttattattttgagatacgttccatcaatacctagtttattgagagtttttagcatgaagcggtgttgaattttatcaaaggccttttctgcatctgttgagataatcatgtggtttttgtcattggttctgtttatgtgatgaattacgtttattgatttgcatatgttgaaccaaccttgcatcccagggatgaagctgacttgatcatggtgggtaagctttttgatatgctgctggattcagtttgcaagtattttattgaggattttcacagtgatgttcatcaaggatattggcctgaaattttctttttttgttgtgtctttgccaggttttggtttcaggatgatgctggcctcacgaaatgagttagggaggaatccctcttcttctattgtttggaatagtttcagacggaatggtaccagctcctcttgtacctctggtagaatttagctgtgaatctggctggtcatgggctttttttgattggtaggctattaattactgcttcaatttcagaacttattattggtctattcagggattcgacgtcttcctggtttagtcttgggagggattatgtgtccaggaatttatcaatttcttctagatgttctggtttatttgcatagaggtatttatagtattctctgatggtagtttgtatttctgtgggatcagtgttgatcttcaatttatcagtttttattgtgtctatctgattcttctctcttttcttctttattagtctggctagcggtctattttgttaatctttccaaaaaaaacagttcctgtattcattgattttttgaagggtttttcttgtctctatctccttcagttctgctctgatcttagttatttcttatcttctgccagtttttgaatttgtttgctcttgcttctctagttcttttaattgtgatgttagggtgtcagttttagatctttcccgctttgtcctgtgggcatttagtgctataaatttccctctaaacactgctttagctctgttgcagagattctggtatgttccgtctttgttcttattggtttcaaaaaacttgtttatttctgccttaatttcgttgtttacctagtagtcattcaagagcaggtcgttcagtttctgtgtagctgtgcggttttgagtgagtttcttaatcctgagttctaatttgattgcactgtgatctgagagactatgatttccattcttttgcattctgttgttatgatttccattcttttgcctttgttgaggagtattttacttccaattatgtggtcaattttagaataagtgtgatgtggtgctgagaaaaatgtatattcagttgatttggggtagatatcttttaggtccatttggtccagagctgagttcaagtcctgaatatccttgttaattttctgtctcgtctatctgtctaatattgacagtggggtgttaaagtctcccactattattgtgtgggagtataagtctctttgtaggtctttaagaatttgttttatgaacctgggtgctcctgtattgggtgcatatatatttaggatagttagctcttcttgttgcattgatccctttaccattatgtaatgcccttctttgtcttttttgatctttgttggtttaaagtctgttttatcagagactaggattgcaacccctactttttttgctttccatttgcttggtaaatattcttccatccctttattttgagcttatatgtgtctttgcacgtgatatgggtctcctgaatacagcacactgatgggtcttgactctttatccaatttgccagtctgtgtcttttaattggggcatttagcccatttgtattttaggttaatattgttatgtgtaaatttgatactgtcattatgatgctagctcgttattttgcccattagttgatgccatttcttcatagtgtcgatagtctttacaattagttacgtttttgcagtggctggtactggtttttcctttccatgtttagtgcttccttcaggagctattgtaaggcagtcctggtggtgacaaaatctctcagaatttgcttgtctataaaggattttatttctccttcacttatgaagattagtttgtctggatatgaaattctgggttgagaattcttttctttaagaatgttgaatattggcccccactctcttcttgtagggtttctgccgagagatcagctgttagtctgatgggcttccctttgtgggtaacccgacctttctctctggctgcctttaacattttttccttcatttcagattggtgaatctgacaattatgtgtcttggggttgttcttctcaaggaatatctttgtggtgttctctgtatttcctgaatttgagtattggcctgccttcctaggttggggaagttctcttggataatatcctgaagagtgttttccaacttggttccattctccctgtcactttctggtacaccaatcaaaggtaggtttggtcttttcacatagtcccatatttcttggaggctttgttcattcctcttcattcttttttctctaatcttgtcttcctactttatttcattaagttgatcttcaatctctgatatcttttcttctgcttgatcgattcagctattgacacttgtgtatgcttcatgaagttctcatgctgtgtttttgagctccgtcaggtcatttatgttctctaaactggttattctagttagcaatttctctaacctttcttcaaggtggttagcttccttgcattgcattagaacatgctcctttagctcagaggagtttgttattacccaccttctgaagtctactgtcagttcgtcaaactcattcttcatccagttttgttcccttgctggcaaggagttgtgatcctttggaggagaagagacattctggtttttggaattttcggcctttttgtgctggtttttcctcatcttcatggatttatctacctttggtctttgatgttggtgaccttcagatggggtttctgtgtggatgtcctttttttgatgttgatgctattcctttctgtttgttagttttccttctaacagtcaggcccctctgctgcaggtctgcttaagtttgctggaggtccactccagaccctgtttgcctgggtatcaccagcagaggctgcagaacagccaagattgctgcctgctccttcctctggaatcttcatcccagaggggcacctgccagatgccagccagagctctcctgtatgaggtgtccgtcaacccctgctgggaggtgtctcccagtcaggaggcatgggggtcagggatccacttgaggaagcagtctgtcccttagcagagttgaagcactgtgcgctgctctcttcagagctggcaggcaggaatgtttaagttgctgaagctgtgcttacagctgctccatcccccaggtgctctgtcccatgaagatgggagttttatctataagcccctgactggggctgctgactttctttcagtgatgccctgcccagagaggagaaatctagagaggtagtctggctacagcagctttgctgagctgtggtgggctctggccagtttcaacttccctgtggctttctttacactgtgaggggaaaactgcctactcaagcctcaataatggtggttgcccttccctccaccaagctcaagcatcctaggtccacttcagactgctgtgctggcagtgagaatttcaagccagtggatcttagcttgctgggctccatgggggtgggatccgttgagctagaccacttggctccctggcttcagctccctttccaggggagtgaacacttctgtctcgctggtgttccagacaccactagggtataaaaaaaaactcctgcagctagcttggtgtctgcccaaatggccgcccagttttgtgcttgaaatccagggccctggtggcataggcatccgagggagtgtcctggtgtgcgggttgtgaagaccatggggaaagtgtagtatctgggctggaatgcaccgttcctcatggcacagtccctcatggcttcccttggctagggtagggagttccccgaccccttgtgcttcctaggtgaggcgattccccaccctgcttcagctcaccccccgtgggctgcacccactgtctaaccagtcccaatgagatgaactgggtacctcagttggaaatgcacaaatcacctgccttctgtattgatcttgctgggagctgcagaccggagctgttcctattcggccatcttgccagccacctcctgttatttttctttaaagagatggggtttcactctgtcattcagtctggagtggaatggtgcaaccgtaacatattgcagccttgaactcttggcttcaagcagttctcccacctcagcctcccgagtagccgagattacaggcataagctgtagcacccagcgagaggaatgattcttttttgtttgtttgtttgtttgtttgttttttgagactgggtctttctctgtcacccaggctggagtgcagtggcgccatcttggctcactgcaacctctgcctcttgagttcaaacaattatcctgcctcagccacccgagtagctgggattacaggtgcccgccaccacacctggctaatttttgtatttttattagagatggggtttcaccatgttggccaagctggtctcgaactcctgacctctggtgatccgcctgcctttgcctcccaaagtgctggaattacaggcatgagccactgtgcctggtcagaagggtgattcttgatgagtaaaacgatgattaggtttttcttagatggacaagggagggatggcgtttaaaagagctgacaatttcagaagcacagttagctcaaaaagcagagcagcacgaggccgtttaccataggaacaaataaccttacacatctttgtaagccttttcagtacagttcaataacttttccagaaaagggtaaaaaactccttttagaaagatttccatccaaaatggtttagtacttgaaataagtcctcggcctcggctctctgaaaaactatgttgcagaatgcctttatctctgaggatcaccagtataactaaacttttagtgtaattctgtgttctagatgatgccaagctcatgaatgtttagtaaatgttaatagttgtgacaatattactgtattaaacattcctttttgttttgtcttgttttgtttagcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaag

SEQ ID NO: 1131 - DNA, 38460 bp, mus musculus; identical to SEQ ID NO: 1130

SEQ ID NO: 1132 - DNA, 502103 bp, mus musculus
aaaacctggagtcttggggaaaaggagaaaaaaaaaaaaacctcggctgtgaagctgtcaaaccgggcatgctcagtagacagggcaggttttttggtctcgagtagcggagaaacattttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccgccggtttagagcaccgctgccagcagccggaggagagcaatgcgggggcccgagcggcagctcgaacagtaatgtggatttacagtcgtttcccgcaggagtcggccgagacgccctaagtcccgggcactggcagcgcccggcggagccgagcacctggcgagggggcgggggaacagcacctggggacgccgccgaaacttgcgcttggaataggtaggtgcgtttctcctggctcccaccccattccttctcgctcccgcccgccacccccaaccttctaccccaaggactacaggcgaacttcgccccgaggctgcaggcggcggatggcggctcctggctgttagcggccggttgagtccgctctgggactcctgcccgaggtggcagagcctccgcatccttcttctcccggtctccgccggccatggggctctggaccatctggggcagaagggaggtcggccttgttcgcagttcaagcttccagcgggccctggggacgctgcccttcgagggctcgctgggcttcccaggcggcacttttaccaaccaactccttcagttctgagagggagcctcctcgcctcggctctcgcgcagagcccagtcactctaacaagtggacctgggtgcttggggtgaggatgggaggctcggtctaaaaagaaagaaaggggcgcttctctggcatccctcccaccctggagcgttcgcctggggctctgccactggggtccaggtcctgctgtctccgcagagaatatgcccaagggctaggacgcactttagtacctgtttgcttctgaatttctatttgagcctcactcagggagcccgggttcccgggggaactgcaggacctcctaacctacgccgccgtcgagggccccacccgatgcgtcctccctatacctttgtcaatctttgtcaaaagagatagtcattacaacccaggcggtgctccaggagccgtcggtgttgactttaaccatgcgctccaatgtgcgggtttgtgtgtttccgcatttcatccagagacttggtccccgagattcagcaacggccagcatatctgcgagcgccaagcacccgctaggcaggcttggggaaatgtaacctcactttcttccactccataacaggaggattgccaatttagtttcaggatgctttgcctagaggcggagaaggggagattgttagcgctacttggtgagtggatgtgtttgcagtcaggagtgtatttaaacatttcagtgaacccgatgcagtcagttgtttacaattgcggagacagaggatctcactccactagtagatgtttccacgtctgtgtcgccactgggagagtaggggcgggggcgggggctggtttgcagctcgtactcgccgtcggcagcttcgggttgagcagatctgcatcactgctactggcgatatgctaataggggtagaaaagctctacatctccaatatgaagcaattggtcagtaaacgtcctgaacttaaccgttgttttcctgggataccaacctggaggtgtttttgaggtggcccaaagaaatacaaagagaagttctcagtgctacagaaaggaaattagtagccatttggttttaaagaccaaaaggaaacgaaacatcccagtgcactctaataggtactgttagattagcgtttaattgatcgcgtttgtgacgagtaagtgtcgcagacagcttccttgaattttagactcttgttctatgattataattaacaagccaggtaacaatgtactgtgagaatcaattgctactcttaacgtgtttgaggagaacatggcaaatgtctgctctattatattttttggctgaaatagcccagttcatcttcctagtccgaagtcttctgatctggagcagtagatactccagtgttaccaagaaagggaagagtctaagagggaaaggcttaaaaaacaaaattaatgaaaaggcgatccacacctttaacttctgctccatgattacccagcatctgcttgcttgctcacccccgctccttgctcttcatatctgcaacgtggggaaaaatgaattttcataaggcatagtaagaccctcaaagtacataactggagaaacagaatcccaattttgccattttagttcaagttcataacactattttgtgatgcattaaataatttactatggcaaagttggggtttttaagagtaattaaaagctttcaggtatgacaaaataatgttgaaaacttttcatgattaaagaaagtcgaaatatgcatttaaaaagggatcaggtaattcctaaaataaatccatgctctaaatattatttaaaagttttcaggttgttccccagaatgtttctgaaaaacaggtgtttctataaaacaactctatgaagaaatgttaacattttcataataaaactagtagagtccagtcctgagaacaatgtcagctatacatagcagaaaaaaaccccacaaatatttttgcatacatgaagtagtattttccattaggtttaggttccaattatgaattagggacagtcatgtcatttgacaaaatatacagtgaggctaaaggaaagaatgctttgtagaatcattgtgctgtaaaggtgattaagatttcaaatattcaaacgtttaggtgtattaaaataaaattgtattatacataactatcatcacattcaaaggcctaattcagtctgaataccctagaattctcagtgtttcaattcagctattatatgtgtaaataacaccgacataatcatagtttccctcatagtcattgatcctttctgatacctttaccagaaagattcttgctgaagcagaacagtctagcattcaagtttattctatacaatattactttaaattgtcaaactgcaaaacattcctgatatgttgtttctgaaaacagaaaacttagtggaaatttattttctgtgacagccttaaaaacttggaagtagtaagaaattttagtgttaattaataaaacaaacatttttcatattctatgttagagatagacatttggagtccatataatttttgcttgaagcttgcttttcctaagtcattcagtttcagatttaagtaaagctatcaagtagttggtatagattatggttaataaattccctaaagtttcccaaaacaagttaattattattatttatgcatttatttatttacttacttataaatgaccagaggtcaaaagaagaccagtactttgaataactgagtcagtgattaatttttttgatgaaaacaaattttcttatagtactcatatttgttctctctctctctctctctctctcacacacacacacacacacacacacggaagcaattgcttgtgaatgccttgaatcagatataaaacatgtacaatagctttattaaaattatatatatttgttaaattgctgtggattttaaccacaaaattaataatccatgcgtacttaaaaagcttcccatcacttaacatttagaagaaaggtttaaactggattcctagtatgactacaggcagatgaaaaatattgtaaggtacagaatttagcaattgtgaccaacagcatatacccacgactggaagtgtaactgctgattataaaaattaaaaggaatcaaatttcagaaatgctcacatataccacaatttctttaaatcttctacagcttctgagtgttagattaaatcactactttgaatggagattgctattatttttccttcccctaaaaggtaaaaatattctgaatcctggcttaatatattatttttattcctttctgttttccattgattttttttagaacagaggaaagtaaatatcaaatataaccagctagaaccatgcttagtttgagcaggtgaatgctataaaaggcttcacacagcttttaattattcttaacaaccttgatgaccaaccataggtgtctgttcagtattcggtgctctgttatggcaatttatataatgtatagagattttgtagtttgctagacgtgctgtggtacaatttagcaagaccagcaaaattgcttacatttggaacccatgaaaaatagggctgaggaaattggaatatgatggcatagactgaaaattattatataacaatatttatatcaattgcaatgctaacatttctgtatagaaattaagctaatttaaatttgaaaagtaaatatttttacaggtgacatggatccctaatattttaaaatagtaacttagagtctaataaatgaagtctattagatttttatgtaacttcaggacccatttcaaggcctggaagtataatcttggataatttacaacttaaaaaattattctaaattgtacttcctgtccgagcctccactttaggtaaacaatagcatatggtgaaacatgcatatatgccaactaaccactacctcttggatgatgtttttaatgtgatgtaatgattctgaaatattggattctccacccccgctctattctaactgtaagagtggagaagctaattggaaaatggacacataaaaacatgttaaaaatctcttttcacatgggtggataatcccctatgaagttcttacctgggagcctttatatttctgtttatggtagatatgtgccaaggttaatactttttctctgggtgcttatgacaaatttctatgactgaatctaggtgacacccaaatatgtgactgcaccattctgttaaccatccaactgtttggggtgaaaaacatctggttgtttgagaaaattgtttacctagtttctgggtgttttggagtcacttaacaggccgatgacccttaatatccatgtcaaaagagaaagaaaaaataaaataaaacactttaaaatacatgtaaaatatcttaaacactcttgggttactataaaatgcccaatgaactaaatgccatcgtgaatctacagccttctataaaatgtataaggagatgttgcttgcattctacaacaattacagaaacagaaacacactgaccttttcagcaaggcaggaaattaaaaactttaaattcaattctacaccctactcccccttccctgcccccacccctgcccactgtactgattcatcagcttaaagaaattgacttaaggggcttgatacagtggcttcttaaaatttcctgtacctcattttccactgattgtgctactgccatggaaactagatgggacagacagctgggagtcactaattcagaatgggaatctgcttgttaatttaatttcatgccagcctgttggtccctgaaagtaactgctgtaaaaggctggggaattgaatttgctagaaataaatgattaagctgaacgaaaaatcagtgccatctctgtcattttcctgaaaatcttcctacaaccctctttgtccctactcaagcaatttttaaaaaataatcacagaaagagaagtttgatttgtgcattcctattggtatgtatgtattctatggagcattttttgttctaatagaacattcacagctgtaaaatagtttcataatagctattacattgaaaaaatatgttctttcaaattatgattttgtagactttgaagaagcctagttagtgatgataggaaaacataatataaatgatgcttgaattttccagtagaattggttatttttccttttcaaataaaaaaagtcttattacaatatctatgtcccacttttattacagagaccaaatgcatttgaatacatttatttgaaatttgtaaaacagtcattttaccagtcaccagaaagcatactggttgttttaattttattcgactaagttgtaaattaataagtagtcaacaatgaggaaattgccttttaatgtttctcatattctgttgtaatgtttttgtggctgattatgagttatgaaattaaattttggaatcacaatctctatgatgagctgaattgcaatccatgtcaagtcttttgcaataccggctaaagtcctgagaaactaatattacttttctgtcaatttgtagctgtaagcaaatttctgtattacgactgagagaagatctttgataatgaaacaaagaatggaaagataaatatatgtaaaggtcagaaggtatttttctgttttaaagttaataaaatttcaaaatatatatgttcaaggtagaactattaatgatagaatgaagcagttattcaaaagtttaggaaaattaatatccacatttttacagtttagggaatactgagaatatcagtatccagttgttgagtgttgaattacgtgtattttattctttggtgtattttttgttacttggactatatctgtgtgatactaaaatctgactaaaacttaaaaaaattgggacaattatcacggaacttgtagaattcataatattggtatcttctttgtcatgtcgatttcctctaacctttcagcagatgcttgcatttggatgaacaatggaaaaagtcattcattcatctggatggttccagcttccactgtttactcaaatcctcagtttttatggttctatagcctcggtttcccttttgaaatcaccatatatttatttttcaattgtttttctatttagttgaaaggtgttgtaagtattcaggatgctgatgcatattatacatatatatgtaactttcaatagaatttctatgcatttatattaaaggaaatccactttcattttaatgttttaaggtttggaatcgacttagtgtttttagttgcctgtatgaatgatggtttttaaacagccaaaataaaagtacgtggctatcagtttgcatacttctgggaaaatctgatcactggctaaggtcaaagagaaaatttcccagttgcatggttttgcataattggtggattctaagtgtgtatattacctctaatgtctctatctggtttagacacctgtcaaagagaaggtgccagattagatggacaattggtttattagatattgcaatccctatgccccagctgcatacagacattttaagaaaactcttcagttgttcagagaaattagaaagagatactgcagatggcttatctcaataatccaggtttttttcaggtacatttaaaattaaatgtcctaagagatgattaattcaggaaagttattgataatgaactaatcttatgctacacatcctttgcacctatgatgataccttattaaaggtgtttcaatcttgctaattaccacctgtgtttaaatatagaggtgtataaatacactataactacacagtggctggaagccttctcaacctaaaattttggtactgtttttagcttactcaattcctatcaacaaaaagtttgtggtcaacattttgaatttaaactctgtgccttatccccctcctgcctttaacattaatgattttctttttttaagctgctctgcttaattgtaagcatttgagtgatactgatgtgtgatctgttctattaagtagcccaaaaatgtgtttgtgtttatgtgtgtggggctgacactttttaaatgaatatttatgaaaacatacatacattgtggacaaggatttcataagcatcatttacagacacatgaatacatcacttatttgcttactttatacttcaaatgaatatgtttttgtgactgtgactcatacgcttaaagctttaagcaatgtaagaaagcatttcagaattgtgaagcaagtcaaaaaaaaaagaaacttttttggggaagatagtattaatttcactaatgagatctagtgaccgctaagggagaagaacagtacagttgattggccaattaatacttattgcttagacttgagaataatcttacattttaaattatcaataaaatcactctaattccttccttccttccttccttccttccttccttccttccttcgttccttcttttcttccttccctccttccttctttttttcttctctttttaaactacttttaaggtttgggttggtatacagttttaagagaaaggaaataggctttaggacactcactaaaatattgggagcgattactctttttattcttcttctgattctggccaattctttatatatgttccagataattataaacataatatgagatattattatttatatttttttcagttcgtaccttctttcagttatcttgggtaggggctataatgtcacactgctttactgggttggtatttattatagatgtactctgttcatgtattcatatgctgctagtacatttgtgatatatctttcctgtttagtctaataaaatcgcaacacttaggtgtgacaccatttatttttggtttagaattcatgaagtgtcaacataaggatgctacattttcttcattgttttgttcttttcactatttgagatattgctttgatgaaacatcggacaacttgtgaaagtgaggtaattttaatgtaaacaattagagttcagtgcaagggaagtattttaactggtaatttaacatggaagagagaaagttttaacaatttacttctgtaaaacatggaataaagtatccttaagaaaatgtgtaaaacagcagtagacatagtgagagaacactggtcccagatatttagcaaaatacttggaactgctttactattgaaagggaaaaaaattaacatttacactgatgatctgtgacaatgggtcttgaaggctcctgttttccacagaggctctccaggtctcatgcactggtctctccttttactgaaaacttcagtttacatacttttggttatatatcacagaacaattttcatgaaggaaaattttcatttgctcattcttccattcattcatttgctaatttatcaaaccttcttcaaagcctctgtttacctggtgctacagagacattaaaaaatcatctttgggagacagatatataagcatactccggtcatataacaaatgctatagtagaggaataattagaatgctctggaaactcaaagattgatatagttttataaatagtcagttatttgaattgattcttaaagagtgtctaggatgttttttagtcagagaatatggagaatcacattccacatgaccttagggctgtgaaagaacactaggttaaattagcaatggggaataccaatctaggacaagagagtgccattttatttcctatccgagcctggggaacagaggtcagggataacgtcttatttccatttatgtgtctgacatacagaagaggcttagtacacatttgttgaatgaatgaatgggttggtattttgctgcatggagataatcctagaaaatggtgtttttcctgaggtttatccaaaattaagcagtgtgctatgttgtagtagtgtcaactgaacgagataaggggttttaaagtgagggcaaggtgaatcaaccttgtgttagaaagacatcaccagtatggaggaaggattgaagtagattaggagtatagtagcagtgagaccaataaagaggcagtactgcaactgtgaccaattatgaggacatgaaccaaggcagtgacagtaacatggagaggagtggacaaatttgagaagcactgataaggtagaatcaatgattctcggaaattgatttaatttagggtgtgaggaagaaggagggagtgactctgaggcttttgtcttgggaaactaggtaatgccatgaagcagaatagggaacacagaagaaaaagttggtttcagtggggataatgcagtcaggtttggacttattcgatgtgagacaccagctagatatccagatggagatggattgtgccagatggaaattacagatctggctgggcgcactggttcctgcctgtaatcctagcagcttaggaggccaaggaaggaggattacttgagcacaggagttccagacaagcttgggcaacatagtgagaccccatctcttttttaaaaaaaaaattaactgggcgtggtggtacatctctttagtcccagctactcagcactctgaggtgggaggattgcttgcttgtgcctgggatgttgagactgcaagtgagccatgattgcaccatggcactccagtctaaatgacagagcaagagcttgttctaaaaaaatacagatctgaagataaagtctagaattagagatctgggtgtcatcaatcaacatagtagttgaaatcgtaggggcaggtaggtgagcttagctagagagtatatacagtcatcttttgatatctgtggggaccaggttacagtaccccccaccatagataccaaaatccacaggtagtcaagttcatgatataaaatggtataatatttgcatatgacctaagtatatactttaagtcatctctagattacttaacaatacctaatacaccggacgcaagggtgtacatgcctattgtccgaactacttgggaggctgaggcaggaggatcctttggtcccgtgagtttgagtccagcctgggcaacatagcaagaccccatctctaaaaaagaaaatctaatacaatacctacacatcactttattcacatggattcaacaaagtacttgctgtgcagcaaattcaagttttgcttttgggaactttgtggaattattttccaaatatttttgattcacgtttgattacatctacagatgtggaactcatggatacagaaagttgactgtatagagtaaaaagagaagcaaagatgaaatattgagaaacactgcatttaagagtttagtgaaataagaggagccttcaagagagaggaagttagaataagatcagagaggtacaagccatacaagataacaagaaaatagaagctaagggaggaaataattttataaatgccatttgggcaaagacatgaaaaaataattcacaagagaggaaatagaaatgggaaatggaaaaaaaataactgaaaaaaacctcaaccttcagtaatcaacataaatgatattcagtgaatataaagtttctcttatgcaaggcaaataagttctagagatcttttgtccaacatagtgccttaaataacaatactgtattgtacacttacaattttaagagggtagatctcatgttaaatgttcttaccacaatttgtatgtacatgtatacatacaaattagaaacaataaatgcctgtttattttaaaaattaaaataatgctcagtgcaatttttcaagtcccaaatgttagtcattcttgatttctcttttttaacacctgacacccaaccaattaacaaatgctgactctaccttcaaactatattctttatctgaataattttcttctcattcattactaacactctagaacaaaccaccatcatttcttacctggaatactgaaacagccttctaattgatatccctagatccatctttgttctcatatagtttttcacacggcaaccaggatgatcattttaaaacttaaacaagatcttatgatctgtctgctctctggcttccaaaggttgacttctcaccacactttaaaaaacttgaaaaatttaaaaaatctttacaatgccctacaaggctttacatgatttggtcactatttattggacttcatgtcttgctatgtcccccctcaaacattgctcataaccttctagccatattgccctttgatttgttctttaaacatgccatgcattctttttttttctcagggccttgtgcctgcttttttatctgtctaaaatgatttttctccaaggtttctgcagactttacttttgttttaaaataaagaacagaagtttattttctcacagttttggaggctgggaagtccaagattaaggcactgacattcagtgcgggaggcagttactccttctgcttccaagatgctgccttcttgctgtgtcctccagagggaagtaccctgtgtccttacatggtggaagttgaaagggccaaaaaacaaaacaaaaaaaaacaaaaaaaaaacctagcttattccctggacctcttttataaattaccaatccattcatgtcttcatcacttcccaaaaggtcctgcctcttaatacggttgcattgggcattaagtttaaacatgaatattggaggggacataaacaatcaaataatagaagtatatgatagatcctttttgactctttcaggatcacaccaccataataatgtcaccagaaaaggtgaatggaatattctagcattacaagtaataataaaaactaacacatatggaatgcttcctaggcaaagcactgtcctaaggactttatatgtattaacccatttaattttcattcagacctctccaggtttactttcttacttcattcagatatttgatcaaatgttccttcatcatagtggcctactctgaccatcctatgtaatgaactttattgtctttcattttctatgcctttatcagcttctatttttctttatattactcatcattaactggtatcatactgtatttttatcttatccacttttctagaatattagttccttgagggcatgaattttgtttcttttttgctcactactatatccatatcacctagcacagtgcctgatacatagtaggtgattaataaatattggttgagtaaatgaatgactaataaggacatgatgaaatattagttggtgtagatttggcagtttgctgcaaaagccttaataatgttcataccaataattctacttctgggactttgtcctaaataaataatatgaaataaagaaaaaacttcatttcagatattttcaccaagcattatttgtgataatagaaaatatgaaggaacccaaatgttcaacaaggcaaatgctatgtgatttatgatatatctagacaaggcaatacataatggccattaaaaaaagatgtttacaaatattttaagataaaaggaaaatgtttatgttatactaccaaatgataaaccaaggtgtaaaattatatgtatccaatatgtaagaaagaaaaaagacttgaaaaagatatgcaaaagtgctaaaaatgattatttctgattgaaaaaggtgggtaataggtcattttttcctttattatctgtattttccaaattttctgtaattagactatataactatcagacaccgtgtatttacaaaacaaaaccattaaaaaaacaaaaaaataaatattgccatatgagaagtgaggtttgggaacaaataaacaaagataataaacccatttttcttgagagatgttgctggagggagaggaatatgccagttttagccaagaccaactattctctgactttattttgaagaggactacagaagggaaaataatcgagatccactgatccaatctggtcttcactcactagagaaccaaagagggcggaacttaccctgctaggatttgaacaggatgttcaagggaaattgcacaaattaagtcttgttcatattgctgtggaaagcactagcaatttgcttcatgtaaaacagaagtgattactcactatatttcttcatgtcatgtagtaaaaacaattaaatgaagttagactatagattacttggctattcagccacagtcacctctaatggaaaagaagaaaaatagcattgacaagttttggcaggtctcatcattagaaatgcctatattgccagaaagaaaagaagcttcagccaataatgtaaaccgagaagttctctaggccttgaggaagaaagtgacaatacagagtgttgcagcattaattgtctgagagcactgatcattgtaatgggaaaactgtctcttttattaacacgattattttctgcgaagtctttgagtaaacgtcccattaaaaaaattgcattaggagtttcaaagcatatatagcgatgtaaagatatactcattaataagataaagtgtgacctatatgccgcccaaagtcccttgaaaatagaaatagcattaatataggtattaaaattacagtataatcaggtaattatttttaaaaagtaaaaatttgtaccattttctaaactaacagaaatcatacttttaacatctatttgagaaagatatctatccatacacatgtatgcatattcacattatgtgcatattcatatatacatatattatttgatgtcaacatcttgaacccggcttttaggcccttcttctgctcacctccaatttatgtattttacctccatagccaatctctgctgaccgttttgttataagaggctgagaactgaaggaagtagaatattattatctatgtaggaagaaacaacaggcagtggtgctaattaaggtctgggctagatgatctcttaatgagctgtccaggtttggacatagggctctgcttgcagggtctagcctatctccaaaaccaatagtcagtcctgtgagatgtatttgtaacctttgtttaatagcttctgctgtttttgcctctggtatgcattatttggctgagttcagtgatggtcctgtcaaacattctaatttctttttcttaaacggtagttagcccacattcagtattaagacagtgaacagtttattttttggaaatgaattcttgagtggaatagagagataaagggtgagggaagttgtacatgttgggaattgttcagtgatggcaagtaacctgtggtatctgacatagatcaatgtattaactggccttctctagtcataaatggggtgacacactcctaaaggaaccagcttgaaaacaatggagaagtgagcagagaagagccctttgtttttccccagtcttctgtttatctcaccaaggcaaaatgctacatatagggcagtttattttttaaagcattttttgctagcctccttgcagaatcagcctgatgtatatgaagccaatttctacagacttgctctggtatatgcagcacaagagccagaaatattttttgtagtctggatctaagtactttctgaaatgtcttcccttgaaagattctaacttagcactattctggaaccacatgaacatctgagcagaactacgtcttttttgagcaacattaacagtgatgaaaaatgcacatcaggcagttagattgcaactaatcaagagcaccacttcagcctagtatgaatgatttatatatagtgcattggatatggagatcattagtaataatatgataccctgttgtcattataaggtcaccttggtgatctttgtaagatatttgtaaggtgacaatgatgttactgaactacattttaaatatggcatttaagtattgtcttctgtcttgatttactggtaaaaattttaaattgtttactcttactactgagatttttcctcaaatataaaaataataggtttggggattacttcattaataaattgggaccataaggttaattaagtgccagtcataaaatattggaatgttaaattttgaagtttcttttttcttctgctttaatttacacactgccttttcttttcttttcttttctttcctttgttatttttttagagaaagtctcgctctgtcatccagcctggagtgcataacactccagctcactgcagcctcaacctcacagctcactgcagcctcactgcagcctcaaccttccaggctcaaatgaccctcccacctcagcctccaaagtagcagagactacaggcacacagcacaatgcctggctaatatttttatttttattgtagagacaggctttcattctgttgcccaggctggtctcgaacttctgtactcaaacgatcctctcaccttggcctcccaaaatgctcggattacaggtgtgagccaccctgtgtggcccacactgccttttctaaaatggatttttgaagaattaaaaacatattataactttctatatatgagtaatatatgtttattataggaaagttagaaaatacagatacacagaaagaagaaaatcatataatttacatacatctatatctaagctcaactcacattgtggttactttataatgtgcttatttaaataaatatttttgaacatctttctatgtgaataaaatatatcagatatgtgcatacacacagacatatataaatacgtacacacacataaacacacagacctacacacagaaagagagagagagacagagacaaagagaaacagagttgaaagaaaacaccaaaaaatgaaaagaaaaatgtgtagtcccctttcccccatctcttccagaatgtcacttagaagcagcaaattaaagatatacatagaaattatatgaagtgatcattaacatctaacagttcccatattatgtttaatggctgcttagtaatccatcacataaataaatccttgatttatttaaccagactccaattattggatatttaggaaatttccaatatttattactataaaaacatcatgaaaaattcttatacatacctctctgtatatatctctgataactccttttgaaatgtttaaatgtaaaataacttgatcacaaggaggacatatttttaagggttttggtacctactgaaaagttgccctccataaatattgcaccaattttacattactaataaatgacttttttctcttttgtttttgagacagagtcttgccccgtcgcccaggctggcgtgcaacagcgcaatctcagctcactgcaacctccgcctccctgattcaagcaattctttgccttagcctcctgagtagctggggttacaggcacccaccaccatgcctggctaatttttgtctttttaatagagaccgggtttcaccatcttggccaggctggtcttgaactcctgacctcgtgatccacccgcctcagcctctcaaagcattgggattacaggcgtgagccaccacacctgccatgaatgactttttaaaagttcatatgttaaaaatccaggtgacttcatactgggtatatataaatcagaggaagaagtgtatctctcaagtggagtaaattagtagggatcattatataatagcacagctccttccttagcaccaagcatggcacatgggagactgtcttagtctattcgtcatgccataaaggaatgcctgaagctgtgtaatttataaagaaaggaggtttatttgggtcacagttctgcaggctttaaagaaacatggcaacagaatccacttctggtgaagactcaggaagcttccaatcatgtcagaaggtgaaggggagccagcatattcagagattaaatgatgagagagagagagagagagtgtgtgccaggcttttttttttttcaaccagcatttctcatgggaactaagagtgagaacttacttgcatgataagggcaccacgctattcatgaaggatctactcccatgatctaaacacctcgtaccaggccccacctccagcactaaggatcaaatctcaatatgtgacttgtggcagggcgaaaccaaccatatccaaaccatagtggagacacattttatagtcagttttatacctgttgaataaaagatgccatgtgggacgttggtaaaaggactgaaccaaaagtgaggggacatgaattctaatcctggctctgccactaaccacatatgtgagtttgaaaaagccatttaatctctctgggccttagtttcctaatcttataacagagttgtttgagaaatagatgaaatacatatatgattttttttataaattgtaaaggacaattttaatgtaagaaattaggactattataaattgtttacactagtggaaactttgaaattgtgggcatttcatctcaaaatgactggtatgttgagtgaaaattgaaaaaaaaaggaaattgaatagtgttcagttgagagagtctatgtggaatgggtgagaatttcatactcctccaggtatactcttctataattaagaaattctttgttagcagcatacttaatataatcagttgaaatttcaagtagaccttttaaaaagcggacccctttatctcttgtgaattgcacaatgaatgttcttatattcacaaccctcatctccacttccaaccctaccccacatgtatctcttccattcgttcatataaggactgctttggatttgcatgcacatatgtttgaaggataatttggcctaatttgtttacaggaattacaagggtgacctttattccgctgtctcctttttgattcccataacttctggacctatcaaggtatgtgcattttacactgaattttactttgagaattgaacacatagctacataatgtgaaaagaatggaatgttttggtgatatagtcagttgtatttattgcatgtcatgtaaatgaaatgcattgttttaaaatttttaaagtctatttgtccattttatagataagcttgtgtctgtacctcataatttttagtctttgcaaaaacaaatatgcaggctgtcttacatgtctgaataattctgtgaccttttccacatacagctactcaaatcaggagtcttcttaactaatgggaacatctgcagagtgtgtaggaacagcagtagccagagaagatgtttgcaaaactatttagtagttcttactgactacaaataaatatttctccatatcaatggaacagataattccatttagaaaattttactggcataaatatttgcctcctgaaatgaatgttttgattctttagtaaagtctcatgtaaaatatttgtatttacacaggtattgcattcatttgtttacccttccgttctaccctctcttcatctacccatctatctatctatatatgtccaataaacaggtattgagcaactttggggcaaaagttattgtgccttttttcgtggtaaatgtgccaatgtaggtataattcaaatggagctttgagagtgtttgcttctctatagtcagtccactgttaggtggactacgtgagaaaatgtggcaagatgaaggatctccctcattggttttaatttttattaaaatattggtcaatgttcagtccttagtaactaaggcacagaaagcattgattttttttccctttgctacctatatcttgcagtgctatgcatcattactcaaatgtgaattctcatttcaagctgtaaaaaagtcaaaaggatgatctgaatttgtggtaagtctttggcatcacttgatactttctttaagagtatgtaaaaaagaaatctgcaaactctcagaatttgcattgcccttctaaaaatataacacaaatatctcattaagggtttccttaattgggctccaattattggatattagtctgtatcagaaatttaaaacgtatttgtcagttttgactatacatgtagttctattagcctttctttcagaggtactgtctttaagggaatactattgccaaaaagttcagattactataggaaaaaaaatgtaagatcagaaaataaaatgacattaaaagataaacttacttaaaaagtaagtcgagattttgcatataatgtcatttgtgaaaataatttttttaatttggtaattatgagtctgccagttgtgcaatactaattgcaaagtatttttcacactaggaaagtttaaatgtgtggaaaatgttagtcttactaagctaatgtgaatgaatggatcagaatggagaggaaaatgcctgacagacccaaagaatgcacacttataaaaataattggcactaaatatttaaaagtttcagagagcagctagtttccctcttttagaaagacaacatgacatagtagaaaagcccttgtttgtcaatcaggaagcctgggctctactctcagtcttatattagtaatacgtttctcatcaggtcacttcttcactctgagcattggttttctcaagtctattataaaaactttgggctgaacaactccaactgtctttctgttcaaacattgtatgatttttagaaaattcagggctgttctcagatatgcaatacggaatcaagattagcaattaaattggaatacacacaccatttaaaagattgctccttgttaagtggtttagtgagttggtaatagtatatttttccttgatttaaagcaattgtgtattctaatgccactatcactcactcactccatgcgtactagtactggcgttataataaatagtttcaagctgaagtttagctagtagtcttgagtcttcttccttgataaaaatgcttcactttgggatgctgctgtgcttcttctctgccagtctgttggagttcagcaaactatgttttcaccttcttgcatgatggtcgttcgaggtcaagcatctctctgtaccttgaaaccatccaagtgcgtaacctgatgacttcagactccaatgctttcaatctggcacctttcatgagcattgagttcatattaaaacatttaaaatatattctccttcatctacatatcacagcagtaacaacttgggcacaagacagtgcctgagaacaaataaccacttggagttaatgatctgaggggcagctgaaggaccattgactcttcctagtcagttctttgtccctataaaatgcctacttctgaggtgccgagccttcagtaatttttctgtctcacgtcagattaagtagtgaccataaataatagcatttaatacataataatgagatgtggcaatgcaataaaatatcaacaattctagtactatattaacatggctattctgatgaaaccaaaagaatgagcagtaaatgaagttcatgaatcataatattttagaagagactttcaccttattgatttgaaatgagatataagaaagaattcatttggtttaggggagcagttccctttcttttgctctgcattccactgatgaatgatctaatttagaaataataaaaaatgcctctgacatctattttaaattgatttttaaatagtgtatgttcagctttttcccctcttttttagcagtagattcatttttcaagatatgtacagctctgaactaagttacaaatacaactctacaaatgttcttttccagaagaagcactttttatttatttattactgtgacaaacatttataagtctctacagtgtgccaggcatggtgctaggtgctggggaaacaaaaagtaatatggaacatagtccttactcataagctcatagtagagagttggggactgtgctatacacagagaaataaaataatcaagtgttgtaggtatggagtttctatgaatttacttgctcatggcatttttaaaataagtttaaaagattcatatatcaaaacctactgagtaaggcaatgatgtgtgtaatctaaaatagctctccactcaaatctgcagtaatcattggttatggtgggaaaaatgcccccccccccgcccgccgaaaagatgtctgtgtcctaatctctgaaacctgtgaatatggcatgtcatgtgaacatgacaaagaggaattaagattgcaaatggaattaaggttactaatcggctgaccttaaaatagggagattatcctggttatctctgtgggcccaatgtaactacaagcatctttaaaagtggaagaaaagaacaaaagagagaaaaacagagagatgggcccatgagaagaacttggcctgattttactggctttgaaaatggaggaaggggccatgagccaaggaaggtggatggcctctagaaagtggaaaagtcaagaacactgattctttcctagagcctccaggaaagaattcagccatgccgataccctgattttaacctatcaagacccacttcaggcttctgacccctggatctctaagataagtctgtgttgttttatgctgtcaattttgtggtaatttattacaacagcaatggcaaactagtacactgaggtttactcagtacggaaaatgtaaggagtagtctctagttgttgatcatgattactgaaaggcattcttcatgctgaaattggtgcacagggttatttacctagtgaccattttttctagatatccatatcaggtccctccatcagaactacagcgatttgtgaggtccctgaaaaacctggcaattctatcactgccactcccaatttcagagagaattcagtcctccttccctctccttctgtggaccacttgtgctccctcctcctatccccttgtcccatatccctccacattgatacctaggatacaaggtttgttgataagtgagaagtaaaaaattatctttttttctttcatgggacacccgcagcaggaagaatgatataggcactaatatcctaacaagttaccctggcatgggtttcatgacaatctaggtgttgggtattaagtagagtgtgaaattgaagtttcaagctagtggccgattgctcagggccagtcctcagatacgtttgtttgcaacccagaatgatttctctcctctcttctccttttcttcctttttaaaaatgctgtagcttgagtgtgtcctctttaattctgtagtagagggtaagtgcatatgctttggggtttaaaaccaagagaagatccaattcggccacatattgactgtacagcttgggcaagtagattaagaataatctctctaaatctcaatctcctaacctctaagatgagaataataattatacctcacagagttgtgatgttgaaaatggcatgcaaataattcataaaacaccttgcacaatgcctggcatataacatagtgtatgctcgataaatattagctattacttctgccactattcttgctatagtaagagcacaaaggatgggcaaacaatttcatctggtaggggggaatgagaagcagatatctggaaacgcttcgtggaggaggtaatgccggtaatactaggaccaggcatgtgagtgtggactgctggggaatagggaatggtaatttggtattgtcagatgaacaaatggtagggatgagaatatgttctaagcaaaagaataagtggcagagaaatatcaaataccctggtctcttagggaaactgcaatcagtctttacaggtagagggtcatgtggaatgtaagcatgagaagagataagcatagagaagtatgctggagacagatatagatggatttccttagcctgtatcctactaaggtggatctccttttttcctgtaggccagtggttttctaatgttgcttgtgaaatttgaagtttggtttattgccctctgaacctctttcttgcttaagggcaactcctgaaacagccacctaggaacactgatgattttatttacataaatatatattttttatttttatttattattatttttttagagatagggtctcactgtgttgcccacgatggtctcaactcctcaagtgatccttctgctttggcctcccaaaattgctgggattacaagcatgacccaccacacctggtggaacatggtttaaaagtcaccactcagccaagcacggtggctcacgcttgtaatcctatcactttgggaggccaaggcacgtggattacttgaggtcaggggttgaaaagcagcctggccaacatggtgaaactccgtctctactaaaaatacaaaaaaaaaaaaaatttcccggggggggggggggcacccgttattcccactaatttggggggtggggccggggaaaccctgggggccgggggggggggtttccatgggcccaaatttcacccattcaattccccccgggggaccgggccggaattctttttttaaaaaaaaaaaaaaaaaaagtcactgctctagggaaggaggaactagagaaagacgtcagtaatcatgtttgtgatatagagggcccacccaggtggtagtatggaggatggattggagggatcaaatatgaagaccaataaaccagttaggagactactgctaaaagctagataagagatgatgggggcagatggcaattaccaatggtgatagcaatgaagagacagagttgaacagtgattctcaaacttgagtatgcatcagaattacttggaaggcttgttgagaaacaaattgctggatcctacatttgagtttctgtttcagttggtctgaggtggggcccaagattttgcctctctaacaagttcccaggggatgctgatgccactggtccaggcactacactttgagaaccatgggatttgagatatgctatgtagaactgacaggcatgggtcacttattagatatgggcataagggaaaggtttctggcttgaaagcctagtcagatagtgatactattcagcattactaaaagcaagtttaggctgagttgaaaaagaaaatgttcataaccctagcaagagagggcagctaaaaatctttattattttttttttgtagagatggggtctcacttggttgcccaggctggtcttgaaattctggccccaagccgtcctcctgcctcagcctcccaaaagcaccaggattagcacctggcctttaaaaatctttaaacaagatttatgatcagatcctaggctttcttctgggcagcttgattctatacttttgtactactagcttctcttgctcccagtccacccccatttatatgccttggtgccattcacattccggaagtgaaagtacaactctgggagggggtagaataatggattccattttatacctgttgagtttggtgagccaacagaacatctaagtgagaaaacctgaaaaaataatttaggcattagtttttgtttattcgtttttaatttaaaatgaggtcatttccttatttcaggttggatattaactcttctttgtgcaaaactggagtagtcaaaatataggtcattttttttttttaggagatggggtctcacgctttcacccaggctgaagtgaatggcacaatcattgttcactgcagccttgaacacctgggttcgagcaattctcctgcttcagcctcctgagtggttgggactatatacatgagccaccatgccaggctagattgagctatcgtgcatatttcctgtcagtcctataaggatttttgagtgttaaatttgctcataggtggcaatcatcctttttatagtatagatcagtgaatccaaaacatgtttattttaaaattccccttgaacacccgtgtgacctagctttctctacgttacttccttaccaaaaaggaaaaatcaaagtatggcagaatatccatgtgggtaagtagaggaaaatagaagagtaccatacagattgacctttttcttcttttctttctttttttttgtagcttatttcagtaatggtcagatatttcactgaatctatctctctaaggttgagagtaggcaaaggaaagatcttaaaacaagataaagtacctacatgcaatggtgagatgaggaataatatagggaattttgaggagcagtagaagtgaatactaaacaaaaaggattaaattgatagacttgattttgttgcaagggggcagttgtactggtaaatcagtcattttgggcacatagtatatccttacaaatattctagcatattaaaattatcaatttacttgtcagcttgcagttccacaaagctgtagaatcatcttaatatggggagcaaaaatatgataagatggtcaattatagtcattcactgccaaaacttccttgaaaagatacacttaactgtatcattcattctcctttgaaggctgctcatcttagagactgattatgtacttgtaatttgtggataggacagccacccatacacttccatctgcaaggctcataaagaaccttaacttgtagactcaattcagtttcttgtaacatttagctccgatctttccaggaaaataagatgcattccttagtacttattcttttatgccagaaaaaaatatggaagaaaaacaactacaaaactaaaaacaaaaccttggggttttgctacgtgtttatagataagccatgatctgaaatgcatccatgtatatcaacaaaaagtccaacattggatgcttaggaaatgggatcagagttaatagaaatggctcttgtagtttcttggaaatctcactgagaagaagttattccttaggagtgttatttcagccccatgatattgctaacttgacagctgaatgcagaaatgtgtcttttgggtgaggcaaagtccagctttttcacagacctccatttcaccttaataaatttgaaatcactatttcttcagctttacatatttccaaagtatattgagaatcactatatatactttttttaaaggtaaagaaaaataaaaaacaatgacaaaaattctgaaatatgtacaaagggacaatataatcccatgccttgtggcaccatatctgaagtagcaagggtcttttctatagtatagatgttgagctggtgaccttcaaatattgtcctgttttcattcaatgtctgacatatgtcagatgaaactgttcaactcatatgactttaaatagctgttttctgtgaatgcatcagctacttattttgtcccagactcatctgtactactgcacatgaaatttaattttaaaatgtacacttcaagtgacatagttgagcatgtcactgtgtgtaatagatcactggttttgttctcgtcttatttgcaaaatgctcacctagttaaatggtatggctataatatgtaaacctttaggtgtatgatgtaaaccttcaataagttaatatcaataatacaaattttcaatgcctttcttaattttgtttaattttacacctgtgttcaaaaacaccctgattaatgctttaatattttgtatatggtgtatgaacacagaataaaagatgcacttatgtacatgcctgatccaagcttacatctacatactggaaaatgtgagtgccagctgagtaccagtttgcaccaagtttatagttttaatcataaaaaagtacatgaagttattattcatcttattgctgagcagtagtttgaaaaggcggagggagaagctctaagaaaatcctttagtaattctaagaaaggctggttttcagttaagtacatttttgtaagtcattttgtcatttggtaaacacacaatgattatgccttcagacagatgaaatatttattagaaagataaatgtggaaatcacaatagtattaaagaataccatgggagtgggaagcctgtcaagaatgttctgaccccaggaaaaagaaatcagaattgccatagagagggaccatagaatgaaaactttttaaaaggttatttccataaagtctgagaaaatcttggcctccattaagatttttgtccctgagagcctaaactgtaagtgtggtaactgctttgtctgcagaataaaaaaggaaatcttcgcttaatcattatcctgggagttgaacatcctgctaacatttgaataaaaatgcctacttcattactgatgggaacacagagttctgtgtaccaaatgatttacagtagagcttactgacagggctatcttacaaatgaatgggctttttaaagaataatacaagttgttaatgtgtatagtatcaaatgaaatatataatgcccacaaattctaaaaagtctaccaagtgagtgctggctgttagaaaaatatagtcctattatacatttaggtaaaatggaaagtgatgacatagaaaacagaattctgatgtgttgacaataccatcagtgtttttcctctagtaaaatctcttacaatgatggaaaacagaactatgaaataaccaagctgcagaggaccttgagaaatcatttgccctaggcttttgctttcaaatatgtgaatgtctacacaaagggtaagcaagtaatgtcgttagcgctatgaataccaaatcctttatttagcaaatatatacagcatttaactatgaataccaaattctttatttagcaaatatatacagcatttaactctgtgccaggcactgtgctaagcactctacaatagtaactggacacatttgtcatggtattgcttttttccctcttctacccctttttcgcctccccttattttttctctacacatcttttcctgtttcctttttctgctatgtggccctccttagtattgttccagacttcttggggtcctccagtataatgaggttactgaactctagtgtaagccctttattctcattgcttttgagaatgtcatggaattcatgtcaaatttgttatagaaatcaaagtagattattttatcattttgctttcatctctatgacttgtcattttatgatagaaataagtgttctcgaataatttggtatccacatagcatgcactgatagttacttccggtgtcataatatcacttatttaataataatattttttggataagactaaaattttaaagaggactgtgtatggaatatttttaaaataatactttctcatattaaatttccagtttgccaaaccacatgagaatcttctcttctgcctcattcctgaaagggtgaatatgctttcttcattttgtattttctcatctcattcttgagtttgtgttttttaatcttataaacttagtaggtctttagcaaaaactgctaaccttgctctttccacttatctcttgaggacatagataatcttaggtgactgacatagttgttattttaaattatagtagacagttcagttttcaagccactctcttccttatgtagacttctctgtgtgttgctcattgacttgtgtgtgcgcatgtgtatgatctagcaagttacgagcaattactgtgtgccaagtactacgctattcattttaaagtgttatctcatttaatttccacaataactttatgaaggttgcacagttatcatctccaatttgcaagtttagaacactgaggccaagggcagttaaagtaatttgagtaacgttacacagtaggtaagtggtaaggcaagtattcagggtattcagctactattcccttgagtcttcatttgttactaactgttaacagcataattctggtttctttaaatctgatctgttttctcttgtttagacatttaggacttcttaagttgaggtgtctgaatcttggattgggcctttagatatggcagatgaattttagactcctgctcaaagaatgtttttattgtggaatacctcaactaaaggattctaatgtgaccccactaaaacatgagtctggtagatatattttgcagtagaaagggccacaatatagtgaatcagtttaactccattttctgatatgccctaatcctttgcttacccatatcaccattccaagatgaaccaatttctctttgtctgatatcagtgctgtttacttcccatgaagcctccttgagtaaagaacatggacatttcttcctggcttattttctatttcttacactcaaactgtgaatgtacttgagatccattatttgtttttctccctctacctttttatccttggggatttcatctacctttataactctaactgctatttcttatataaataatttttaaaatatttcttacactatggtcccatgtctccaacctcttgccacacatgtacaattggatattctgctgatatctgaaactcattgtgtttctaacggtgagcacatcatatttccgaggttggatcccctgtccaacttcccagtttctgttgatgataccatcattcttccagctacccttgaggcttaaaaccttgaggctttcttttctttcttcttgtactttgctctccatatctaaccagtcattaggttccatcattgcttcataatgtcctttatttccatcctttattttctgtaccactgccatgagcttatctctactttagacagtttaacatcttactcattattcgccctctaaagcttagtatgtggccttgcccatagcagggattcagagtattttggttttgtgattgaggtgcaggttacctcctgcctccagcaacaatgagcacttttggaacccagcctttttgagtttatctttcttgcatgtgtgcatccatctctttggtagccagatatataccaatattcttttcaggtgtatatatttttgtcagactcagtgttatatacatgtctttcatgagctacaagagggaaggggactgaaattgatccagaattaatgagttccaatgctttaaaaggacaatcagggcattttatctagtgagggtgagacaataagctccatggcaatggagactatgtaggctttaacactgatggattcccaggacctagcactatacttagcactagtagtatttaatgaatatatgttgaatgaattaatgaataagctccaatgatagtgacaactgtgctgtcccaaaagaggagaacaaaagtctcctgacgacttgcctcattcactttaatatattaaactggggagattgcacctaatatgctgagatttttccacatggccatatatttaaggcaataattgaatctttaagaaaaatttatgttcatactaaattatatttctcgtgggataacatgacatgattctacttggacaccacaaattatattgatagggtgaaatgtgttttcatgtctgtttataaaatgtggaatattattgaattacttaaagtgttgtgtttgagatgagcttaggctggtttctttgggtttgacacatttcagtctgtcatcctgtccttagagatgttgaaaattaaatggggatacttaaataatttaatttataagcttgcttacagctatgtggtttatcaagccagatgtcggcaccctcagtttcttgcagttgagatgcttccagaatataaattaaaattggttctgcatgtcaagaattagcatgtaaaaaaggaagaaacttctttctcaaatagccaatatttgtgtagtatttgctgggcagtgccatttttttttaaccattagccaattttaagaaagagtataattcattcataaaataagcttaactatatttcggggaaaatcctattccatgtacatatgatgacgtaactcacatctttataacacaaaagtctataatagatatgttattctagtttcacgcctccctctctccagaagtcattttctgctgtttttcaaatgcagtagatttactcaagtttttatggttacaccgccaacatttccagttccttttttaaaaaattggtctagacaatattttaacaggacgtttttcctagtgagaaattatgcatctgagctcttcttcccccacataaatggaaaataaacaacagcttctatgtaatttaagcaaggctgtgggagacaacttgaggtgataggaacaatgcaggatggcccacattcaccgtgggaccttgggcaagtcaattgctctatgtgggtttgtttcttctcgtttaaaatgggggggggtgaggttgaatcatctctcagtttcattgcatgctctagaattctttgagatgttgtaaagtcttaggccacctctctttccaggttctttgcagtattaagctctttctattctttaaggcccgtgaaacattccaaggttcatgattccaacttgactttctcatttttaaaagtcctaacagcatttttatagtcagattgcagtatttagcatgtttatactgtataattatgcttgtctaattctctttatctagctctctaagtgttttcttgtccactaaaattatctttccaactggattacaagaatcttgaatacaggaactatgccttttacctctattttcttcatggaatctgttatattctaaagtaggtaaaagtatcaattgatttggattagattataatcacttatcacctgggttgaaagaacttgaagtatgaacaaagatagcctctttttatggtatattgaggcttcctgtcttagtctgtttcaactgctgtagcaaattggccataaactatatggcttataaacaatagaaatttatttctcatagttctggaggctgggaattccaacgccaaggcactggcacattcagtgtctggtgagggctgacttcttggttcataaagagccagctttctggtgacttgacagtgatgtgacttctcattgtattctcacatgctggaagaggtgagggtctctctagggcctcttttataagggcactaatcccatttatgaggactctgccctcatcacctaatcacctcctgaaggctctacctcctaatactatcacattgagtgttaggatttcaacatacgaatttagagtgggggcaggggacacaaacattcagaccatagcacctcctctgaaattatgaataatttcctctagatcccttaaattgaattaatattacaatgaaaaatactttttctgggtctttagatctcggggtataatttatgtgaagcaagtccttgtttgacaggaaggtgttactttggttattttttttttctggacctttaatatcaactttccaatctaattcagccaaaataaattgagcacacattatatgttaaaaattgtgatagactctgtggtgagttggagggaaagtggtgtgtgtaaagattgatagaaaataatttttgccctgactgcttcacagtgaggaatttgggatataatagatacaaaaaccaacaaacaaaataactcctacaatataatttaataagaacagtaatagaggtagatgtgaagtgatttggaatcacagacaagaaagcatcttactatatcttatggcttatgtctcggaatatactactcaaaggtaacaattttagaaaatgactaggaatttggttatcagaaaaggtagggaagcgcatcctagtaaatatattaaagtaaaagcacaaagacatgcaatatatctgagagattatctgatatagtatagtcagattacaggatgttcagggaaagcatttcatgagaaggtattggagtggtaataaggtttttagcttatcactgaccttcgaagtccattttattccctagagggtatacacccttgagcattttctaaatgtgaagaagcccatagggtgggagagctggtctataagaggaacttgcgcaattattttcttcctgtcgtgaaatcttcagaatcaacttcttcaactgtcctatatatttaagacagtcattttttgttcttttctcttgaatgtgtattaggaatggtgagatcgtctgaactcattttatgactaattaaaataggggaggaaacccctgaatatgcatctgaaactgaactcttacaactcacagcagtagatagcaatatagacaactgagactacattgcattcaggcttgaatacaagaagcttattcagcaaagcttggaatggagacttctctttctggtgcacttttcgagtatcagtggtggatgtctcttattcccttcaggcaaccaaggacttcacatttatcctctttctttgtgtctactcgcttctccctcaaaaacataaggcctgctctaagaaaaggaactgacgaacttagtcatttggaaccataagtgactcttaaggctcagtgggatagtctcccagtgctgtttgcattttaaggagataaaggccttgcttaacttaaatcacaagctttaaattttacagcagcacctagtccaatgagggagacatttggtatcttatcttaatgataggtactaccccaacattaatagcatgaaatcactgataacacttcatgtccttttatcgtgtccaataatattaagctatttgaagtttgataggttttgcaactgaaatgagaacctacagctagatttttataataaaaacagtataaagcatttgaatttctatgttatttcccacacttactgtttccctttatagtaatgaatagaccaagccaggcataaaaagaagaatgagaatgaaaaaaaaaaaatgaagaaatgactttctgggcctttggctctttcctatgggaccttaatttagacttctcttatatgtttctgagtttaagaaactgacttttgattgacaaggatattgttaaggttttgaatagaaacttagctattgaaagaattgtatcttagatgtgcagattagggtgggttcagggtagttagtattgagagaaaatgaagactattaaatgtatctgatggtcagatataaactagatatctcagttcctttaaaagcaaggccaaagcctgactgtgcagcaaattaagaaagaagaaaattactctgatttataccagccatgtgtggccaccatagccagtttgttagcccgttcattggaattggatttctgagttatttatttttttcatcctacattattgccatctttaaaaggaatggggtcatttttcagcttcatgcattgataagtaggtatacaactcccactgtttttcatatgtgtctaatttttgccactctcctgacaaatacgtgacaaaacagaagtcagtatattgctttttactttctcagtagtaaacagctttagcgggagttacaatataatatctagtgatcataagtagaaacaatttatttcagcttgcaaatattcctggggtatacatggctgggcactaggcactgagatagaggcaaaagcaaaagatgtggcttcttccctcaaaatgcttaccctctaggataaaaaatatgatctgcgtgcgcacacacacacacccacacacacacaggagatactggttttctgtggctgtgtaacaaaccatcacaaactaagtggcctgcaatgacaccaatttattatttcacagtttctttaagtcaaaagtctggtcatgacttagtggtttttctgctcagtctcgcaaagctgcagtcaagatgtcggttgggcttattctcatctggaaggtcaactagggaagtgtccactttcaactccctcagattattggcagaattaatttctttgtaggtgtagaattcatggcagtttgtttcttcaaagctggtaattgagaccgatagtctctgctgcttcaaatctctaattttgggagtgactttaacccccttttaaaggactctcttgattaggccaggcccacccaggatgatttctgattaagtcaaagtcatctgactggggctctaatacaaatagaaaatccttttgcctttgccatattctgttgggtagaaataagttataagttctgcccacactcatggggaaggtattacacaagggcaggacttagtgagtgtcatactagaatgtgtttgccacacacagaaaacactaaatacaagcaatgacaatacaagtaccttggtatggacaacaagtctaaatggaaagtatgtacagggactgaggaaacacagagcaaaagggtgatctctgcatttatccagcaagtttactatgcactagccatgtaccaggacctgtgctaagctctgaggctgaaataagtgcaaaatggcaagtgccctaggtaactcttgaaaacatacaatgcacaattccagaagacttcagaaccctattaaatactgttatctgagaaagagacactaaagacacagatgatgataaatatgtttactcatagctatgagttccttatatcttgctgtggaggtacaatatgacaaacacacagacagacacacacacacatacacacacacaagcatgtctacaaagcagtataagtaggtttgactgaatataacaatttccaaatatatcccttgacacaaaatcatgattgctttattctggcctctttacttactttgtgtggaaggtggaaaattgtaataatcatggccagggtttggaggtctgactcttcagtctattcaattagtgcatgtagatagcaaagcagcttctcagtttagtcgttgcattacatatcacttaatgtttgctttaatctttttctatttattaccttattggatctgaacaccagctctatcacacacacacacagcaaaatttaccgtgcccactttatagagggatttcttgtccagatttagataagcaggatactgaaaaacatgggcgaaaccctaggtcttctcacaccaaatccagagttttctatgccatgtttatgaattaacaagaaggaagtgaggtggaggaaaaaaataatatagaaaacaaattatccagcttcactagttctaccacatataagcttgaccctctcattctgtgtttggtggatcctttgtccattgttcatttttaagccccaaatcatgtaggctagagttctttatgaagccagagtatttatactcaagagtttatgaaaagttgttgtccctaaaatgtaccctcagactcacctagagggaccacttccagtgaataggttcttcgtgccccattagtttcttgatttctctactgagagtgcaaacaagcttcctgttttcacaatgattgtaatgatgtgaacatttacccattgggaatgagactgaaatcaccaaatcatttcatatgggctattgcacaattgacagttatgataataaatgtcaggacactgctgactgcttgttcaaatctactttgggactttttagttcatccagttttcctccagattttatgttctttctattattcaggctacttcaggccaaatatttagtcagtttttcattttgtagccttactgtctgcatccgggttttacatagtatattgaagagactgcttggtcacctaaagctgctccattttgtcattgggaaagcatgtcaggcaataaatcctgaaaagaatgaacgtttgctttatataggtatctcataatccaattgcaaagtctctctcaggaatccactgcaatttttgttttctgcaggtgaaattcaatgagataacaacagtgccatatatgaagccataaaccaaactccttataaggatttgattaagaggaagaaggaatttatggttccaggcttttagataccacctaatatgcaattttatctgtcttcaattattcataagtcatttcacagacacattaagatataccagtcttcacatccaaatatttttggtagcatgtttttccaaaaatctccttgtaagattaaatttaaaatttgagcctcagtattcaatatggtctagcacaaacatcctgagtatctcactttacacttaaatttattagactaagaaactgggtccttaaatgttagctgctggctttattattaactagcagtgtggcggtgaaaaagtcatcacaacctctccaggactctattttccagtttattgcccaaggcacttgtgaaaaaatcaagatagtgtacatagaaaaactttatagaaaatggagaacaatggacagaggagttattattagtaataataatggttggtaagttggatgaggttgctatttaaattcactatatgcttaaattttgtaaatgatcattttctagtgtgaacacagcattcttaaaattgtttcctttgaacttacatgttgttttctaagaaggttatgatgttttaaagttatcaagtgtaaatgaaaagagccaatgcatatatttaatattgtttttacttaaagcagtgtatataattagtgtctactccctaacgagtagggtgtaaaaaatgaggtacagatattaatttgttctgcttgctatactacattatatattcgtatgcatttttaaaacatgctttagctcaatatataccacatttgcaaaactcaagtgtcatcagcatcaaatcatttgaattattttttactaacattattttctctttaatggcaagaatcgcggctgtttaaagcacccagaaagtaactcaggccaaccatgatggcttgaaaatgtgactaatttattagtcatgcagtgataaactatatagtgaacagggagaagacaaaatgttttccaaaagaaatatccatgtaattttcaccacctgagttctccactgaagcaaggttaagaagttagcataatgttcttcctgaactgtgggccctgtgccaccaggctttcagaagttgagcagaaaagcagctcagcttttgtcttcccactgtcattaaaagcatctctgcttctctttcccttacctgtatccatgggagtctcaccacatcaaggaacattacctgtcattgtgatgcatttaagatgcaggtgtctgaatttttctttttccacttttttatttcatgcagtgtagtaatttaggcttcctatggagaggacatcttataaatgaaataatgtctcagatctgcatatacatgtgtctgtattagtgtttaatggttttgttttgaatcaggggtatagtggctattaatagagccagagaatatggcaaaaatccaactttctacacatttatgtttaatatgcaaaaccaattgttttccactccgttctttcctgctttctcctcctgtgtcgtttccatcctcataatggtgttaagaattggtataattttgttaactagaggctatgcaaattaatagagaaggtttattttgatggtctagataatgtgaaggagaatcactttctcactgtaaactaatctgtaatgacagacactcaatgtcaattgtgtcactgacagctttttatgccagctttagcaacctttgtccttctggatgttttctagtcatgaacatgatattcagtaatgaacacctttttggtagaagttgaatggaggtgatggctggtattggatgtaagccatattccttttccagaaacttaccgtactcaggaccaatacatattgactctgctctggtatgtcttcagtaatagaacagtgcttacaacgatggcatacttatacaaattaatgagtcagtagagaattaaagacacagaggaaaagaacttttccctgttatttactcaatgaagtataatttggaatgttgcgattatgccttaggtgcattcttagtccgatgaaaaaagtcaatgaggcaagttttacaagtattcataaactgtctactatgtgctaggttctttgctaggtgctctgccaggtgcaaagcaataattttgacatttcaaatgttatccttatgtgctttagacttaagtgcaatacaaattcagagaagagaaatttagtgtagcctgtattatttgttgatggctttgtagagcagttgagacactggatcttgaggaagatctacaatctggagagattaagaagagtagtgaaaatattccacttgggcagaatgacataatgaatgcctcagactttatttgataggcaagagtaaattgagaattttaagcaggtatgttccatggtcaaatagtattctgagagggattgaaagtggctggaggagggtgagggtttatcatttagaagggtattgcagttagctatatttatcaatcacttaaacaaatggtcagttcaggctttgtgtacatacatggctgaaatcagtcaagtaactagttgttttgaaattagctgacttgaaactgttgtgaaaacaaccagtttgattgaattcacttgtttctctccagatcagctcattattacataagcactatgtgttagttacactcagaaaaaaaatcacttaagcttgttgtttcatggcttataggcaaacaagcttgtagattacctaaaaatttggcttttcagttggaagtttcagtgttgtgtcgatacagccttttaagagttccatagatattggcaggcagtactaagatatgttagaattagttgttaggaaacagacttaagttatcaagagtagcaaaataagtccttatggaaagaagtgacaagacacacatagtatattttattaaatattttcagtggtttataattaatgtataaattaaaaattatattaatagaatgaagaaaggatgagaaggaaaaagtgacaaaaacactttttatatgtcattttaaaaataatccatattggaaaacatgactattgttaggaaacaggcttctctgaagagaaacagtgtgtttgttaaaaccatattccgaagagttagtatcaggctgaacattaagcagagttcatggatatttgttaaacatttattttctcggatctgaatgtcatgtcaaacttactttacctgaaggaacatgaactgctccatccttaaaaataccctggggcatctttatttttgttcctaatagccaacctaaatacaatagttatactgatttgtcttgattatttactattgatgcattctagataatcattatgatgtcattggcaatgccaagtaagttagctggtcatgacagcctgttgcaagagtggctcaccagctaatcacactgatcctaggatgagtggggcaatatgaggcaagaaaagccctttgagaaaagaaccacttctctgtggcagttcttgtccaacaaacacacactgctactattgagttctgtccagcttccagataatagctatatccattatatagcatccagagaggctagaggcagtaataccatttaagaagctgttggcacagcccaggagaaagttaatgttagcctggataaagtggtggcagcgggggcagcattggtaactctgggaagctggaatactgagagtgagaagagagagggtcagaatgactccaaggcttcaaccttgggtgactgagagtgtgggtgctattaaatgaaattgggcattcaggaagtagagtaggtttgtgatggggaaagatgttctattctggacatgtcgtctttgcagtgttcaagggggcaactgttggggttgtgagatttgggtttagaaaagagattcaagctgcagatgtagatatgggagtcatcttatcttcaaaatttagatgttaattgaagctgtggcaacagatacaattgcccatggagggaatatagagagccagcaaaacaaaacaatataaaatggattgaacaaaagacttgaggtgctggtggaggaagagtagccaatgaaaatgttagagaaatggcagaaagaagaatgagaatcaggacaatttaatgtttcagaatctaaaggaacagagagaatcaagagatgtggaggtggtcagcaccatcagatattgcagaaaagctgaataggctgaaaattgaaaaaaagcacctggatttggcacattggtgaacttcatttaaagagaaatttcagtgtagtagaaagagcacatatcatattgcagtgagtgagttactgaggaagtagaagagatacattctgtgtcacacatcatcagtgatagaagctatagtgataaagtaaaaagaaatgggaaaattgtcttagctttatggattttaattctgagagtgctcaaatgcttcattaggtggcatccccattccatatgcttatccaccatgaatccagtctaactcttccatctacagtatctagagtagtttgcccctcataatattaacatagctgaagcagcttcaggcatgacaacctcatacaacaatgcagaaaggggcagaaaaaaaacctagttgattcttgttactttttaagtgctaagaaatctttctcacctctttaccgcaaggagccttcctctcatatctcattggacagaattaggtcacatcactcttccttagccaatcactggcaaaagaacacgtaattaccataatccacctatactaatcaagattaacactctgtgattgagtcaggatctggagatgcagctttagctgggacctgggtctgggtctgggtctggaactagactttctttattcaaattagctttattgaaatacaattcacataaaataaaactcacccatttaaagtataaaattcaatggctttttatctattcacagagttgtgcatccatcaccaaagtcaaatttagaacagttttattgcccctaaaggaaatcccatatccattaaacagtcactctccattttcccttccccaatccctggcaaacactagtgtactttttgtctctatggattttcccagtctggatatttcatataaatggaatcatacaatatgtgggttttgatgattggattctttcattaagcataatgttttcaaggttcatccacattgtagcaggtatcaacacttcattccttttatggctgagcagtcagccctctatgtgttctgcatttgtggattcaaccaactgtggattgataatattagaaaaaaaacagtaaaaatacaacaataaaaataatttgaattaaaaactaatacagtataaaactatttctataacgtttacattatattaggtattataagtaatctagagatgatttaaagtgtaccagaggatgtgtgtaggatacatgcaaatactatgtcattttagataagtgacttgagaatgctcagattttggtgtttgaagcagtcctggaaccaaccctgaggatatcaagggataaccatatataatattccattgtatggatacagatattttgtttgcctatttattagttgttgggcatttgggttttgttttttttttttttttttttttactttttggccattgtcgaaaggccaaagcaatattcattgctatgaatatttatgtacaagtatgtgtataaacatgttttcagttttttggggtatatacctaggaacagaattgctgggtcatcagttagctctatgattaacattttgtggaactgacaaactgttttccacagtgattgaacaattttgcattcccatcaacaatttaagagtgtcccatcccaatttctctacatcctctataacagttgttatcttttttaatagctattatagtgagtgtgaagtagtatgttataatggatttgtagtctttcttgaagcatatagataagtggaggagcgaggatatctgaacaaatctgggatgattttaagacaatgccatagaactgttgtgtggcgtccatgagcatttgtgggctattgtacccaatttcttttctttctctctctctctctctgtttttttttttttttttttttttttgagacggggtcttgctctgtcgcccaggctagagtgcagtggcacaatcttggctcactgcaacctccgcctaccgggttcaagcaattctcctacctcaacaattctcctgcctcagcctctcaagtagctcggattacaggcatgcgctaccacgcccagctaattttttttttttttttcagtagagatggggtttcaccatgttggtcaggctggtctcaaactcctgacctcaagtgatccacctgcctcagcctcccaaagtactgggattacaggcatgagccaccatgcctagctttctttttctttttcttttttcttttttttttttttcattgatggtggagtctcaccctgtcccccaagttagagtgcagtagtggtgatctcagctcactacaatctctgcctcccaggttcaagcaattctcctgcctcagcctcccgagtagctgggattacaagcgcctgccaccacgcctggctaagttttggatttttagtagagacagggtttcacaatattgaccaggctagtcttgaactcctgacctcaagtgatctgccggcctccacctcccaaagcgctaggattacaggcgtgagccaccatgccctgcctccaatttcttttttgactgaactgtttcctactggttagttgtgcctcctttgggtctcaaaatctcacctcttcatgtgctcatgcactgctctgtctttaatctcctatgtagcctggatctctagaagctgactctaacattctttatttaaagaaagaagtgagaattaactattatagaccaataacagagtctggtcacaaataaatacaaaaaatgttcttatttaacttaatttggtaacttttttggatttacttcaactttacatttgatacattatttgaattatcaaaattttcaggtactgactcaggaaagattcagcataataggcaagcatatttggatctaataataaattatataattgaaatatggtataaaaatataactcttaaaattcatctgggctgatctattggttactgtgatagatgatatagatgttacaatagctgattggtgttataacaccagttcttagaggaccatatatttgtcaggctcatttacctcaaaagcaggagttaggtttggtgaagcatggcaaagagtaaatttttagaaacataatcatgggcataagaagtcttactcaggagatgggtgtgcgggtcctgtaaatccttaggccaacactaaattcagtctgagcgttccaagggagctagcatgaggatacgttaaggggcttaaaaccaaaagtgagagtctacagcttttttcttgtgattagcaatcatacacccatagagctgctgtgtggacctccatgaccatttgtgggctatagtacccaatttcttttttgactggactgtttactactggttagttgtacctcttttgtgtctcagaatctcacctcttcatgtgctgctagactgtttctgcctttactctgctatacagcttggatctctggaagctgactctaaccttctttaagtaagcacttgtttttttttttgttatcagacactgctatttgcctagccaaccaccatttcctctttcttcattgtcaatattatgttggatgtttttcaggtatcttaaaattctagattcataaacatattttattttataaatgaaaaggaacttagaagccatttagtcagtgtcttaaaactgtgggtgggcaatttgcctactaataccacatgggtccttgctctctcttgggaatctattaaatcagcatctccgggagtggaacccaaacactggtattttgcaggctcccaagagtagttaaaatgtgcatctagttagtactagtataccatcccaaaaattactttgagggacatgaatgttaatgttataaaaggctatgctttggtacaaccctaaatttttctgattgatatcatgtggataaccatgaccctgtatctctgctccagaatgctccttgatacttctataaagaccaccttgactaggaaggaccatgattgactcagtttgacattttgctttttttttttttttttttttttgagatggattcttgctctgtcaccaggctggactgcagtggcatgatcttggctcactgcaacctccacctcccaggttcaagggattctcctgccccagcctcccgagtagctgggactacaggcatgcaccaccatgcccagctaatttttttatttttagtagagacggggtttcaccatgttggccaggatggtctccatctcttgacctcgtgatctgcccacctcggcctcccaaagttctgggattacaggcatgcagcactacacctggccatgtgatttaaatatatatatatttgtttattacctatgtcaggatgtaggtaagaacatatccaaaaaatattccttctccgccataaatttgatgtctctgttttcaggttagggttatgtgtattagaaagttatcctcatattagtatgatattttctatatacatttggcttgaaagacaggttttaggaatactgaagaagattgaatagtcctttttaactttaacagctagtgagtttgttcaaataatgacacttttcccctgacttagagataattgctcgggtatgtgtttaagtgaagtgttttgggaaacatacttagttatatccatgttttcttccatgaattgtactctaattaagctctgaataaaataggaatgcttttttataccttggttttgaatccattcactttaggaatgcattctaaacatgaccatcagtgctgaattcataatgcaaagttacttggaaattgaggcatgctagttcgttcccaccacatcgacttattgggagatcggccattcttggaaattgctcccagagaaaccaatcatcatcaagttttattacacatgcatagtgtatagtgctccaggatccataacagtaacaaaatatggtatcagtcgatggatacaaaagcatatgtaatgtgtaaatgtctatctgcatgcagcattgtactgagcacttaggtagtaactcggtgctgacacttgtattttcaagctatattgcatattggggtgattgacacatcaatctagttaaacagaagcagaagcagaaaactgtcccagagcttcttacaggaggcaaacaacttatgtctacatgtatgactatggaatcatcttttacgtaattaagtaaaaatgatctgctagaccagttattttcaactctggctgcatattaagatcagctagggagagttttaaaaaataaagacaaccagttctttctctcacagattctggtgcaattggtcagaatggggcccaggcatcagcatttttaaggcccccaggtgattctaatgtgcaaccaaagttgagaatcactgaacctgactatgcatcatgaggataggagccatcatttgtcttgtttactgctacactcttttgtccaggccagtgcctggcacataatacttcaataaatatttgtttcatgcaaagttaccatctctagaatcggtagagagctgaacatttagactcagttatccaggcattcaaaaaccaacatttttgtggaaagcagtttggcatttcctcaaagaacttaaaatagaactaccattcaatccagcgaactcatgattgggtatatacctaaaggaatataaatcgttctaccataaggacacatgcatgcatatgttcattgcagcactattcacaatagtaaagacatagaatcaacctagatgtccatccatgatggactggataaagaaaatgtagtatatatacactattgaatactgcacagccataaaaaaagaatgaaagcatgtcctttgcagcagtatggatacagatgaaggccattatcctaagcaaactaatgcaggaacagaaaacccaataccacatgttctcacttataagttaaagctaaacgctgaatacacatggacacagaggagaacagcagacaccaatgtctactttgggtggagggtgggaagagtgtgaggactgaaaaactacctattgggtactatgcttattaccggggtaacaaaataatctgtacagcaaacccccattacacacaatttactcatataacaaacctacacaggtacccctgaacccaaaataaaagctttttaaaaactgctaaatgtttatagcagttagaggcctgcggatggttacaaaagagatgatctcacaaaagccctcaccaggaggtcttctcaactagtggtagattatgcctgcttcttgcctaaaataccaaactgtcaaaacaaaaaaatacaggggccctgacctcaaggtgtttgtaacctacataaaactactaatttcctacttttttgtggtctccttcttgctcctactgagaggtgacagcgtgctggcagtcctcacagccctcgctcgctctcggcgcctcccttgcctgggctcccactttggcggcacctgaggagcccttcagcccgccgctgcactgtgggggccccttcctgggctggccgaggccagagccggctccctcagcttgcggggaggtttggagggagaggcatgggcgggaacccgggctgccagcagtgcttgcgggccagaacgagttccgggtgggtgtgggctcagctgccccacactcggagtggccggccgggcaatgaagggcttagcacctgggccagtggctgcggagggtgtgctgggtcccccacagtgccggcccaccggtgctgcgctcgatttctcgccaggccttagctgccttccagcggggcagggctcgggacctgcagcccgccatgcctgagcctccctccccccgcccgcctccgtgggctcctgtgcagcccgagtctccccgacgagcgccaccccctgctccacggagcccagtcccatctaccacccaagggctgaggagtgtgggcgcacggcacgggactggcaggcagctccacctgcagccccagtacgagatccactgggtgaagccagctgggctcctgagtctagtggggacttggagaacctttatgtctagctcagggattgtaaatacaccagtaggcactccgtatctagctcaaggtttgtaaacacaccaatcagcaccctgtgtctagctcagggtttgtgaatgcaccaatcgacattctgtatctagctactctggtggggccttggagaacctttgtgtggacactgtgtatctagctaatctggtggggacgtggacaacctttgtgtctagctcagggatttatttaaacgcaccaatcagcgccctgtcaaaacagaccactgggctctaccaatcagcaggatgtgggtggggccaggtaagagaataaaagcaggctgcccgagccagcagtggcaacccgcttgggtccccttccacgctgtgggagctttgttctttctcgctttgcaataaatcttgctgctgctcactctttgggtccacactgcctttatgagctgtaacactcactgcgaaggtctgcagcttcactcctgaagccagcgagaccacgaacgcaccgggaggaacgaacaactccagaaacgccgccttaagagctgtaacactcaccgcgaaagtctgcagcttcactcctgagccagcgagaccacgaacccacccagaaggaagaaactccgaacacatccgaacatcagaagaaacaaactctggacacgccgcctttaagaactgtaacactcaccgcgagggtccgtggcttcattcttgaagtcagtgagaccaagaacccaccaattccggacacactacgtccattaagaaatgtggacaaacagtactctaggtgagtctgctttttctttgaataataatattaaggggaggaaggtagatatttgttgtgtgaacagagcaacagacctctgtggaattttcaaagtagttttcaagtctgttaacacggtaaggtgtttgggttatactcttgctgtaacttccaactttgaaatctagcttactcttaattgcgtctcagaaactttgccaaacagaaaactttctaactagttttcatctcttactctttctcatgacttcgatgacttcagaatcttatcccaaaccccagggttatgactccaatttaaatatgtaaattaaaaaaatgtaatgccagtgccctttctttttagtgtatattggctccaaatgctggcatagctgggatttgataattactttgtcctatagtaaatctagttgggtagtgaatcaggtaacatttaactaattgattgtattttctttttattaattccatgtttgcaattgagttatgtatgaagcagtaaaaacatcctgctgttctttttgtaaatgatgttatattttatcacacagtgtcttaagaatactaatgcttaaaaagatgacttgaggattaaaatgcagctttagcttatgggagaaataccactcaacaatagtagatacaacatacatgtagtgaaaatgacaatcaaactggtctattaagtgcagagacagatgtcctatgtaagagatttctgtgtcattgctgggaaacgtgtgtgtgcattattcatctctgctcaggctctacattcaaatcctttccaagtattcccttttgaagtactttcatgctgaattgctgtctgtgagtttttgccttacgtttaacacccaatttgtttcctctcagaatcacagtagcaaagtaggggagaaactaagggtcaaagaatagcttaatctgaaaatcccagttttatgcagttggtataagaggactccagtaaggaagtactttatgaaagtgaaagctctacaaatgttagatgggattatttttattcaactatgtttggcattaaaataaccttagttgtgctgattattaactttctgtaattacccatcaagaaaaggaaaagaaaaagaaataactttgaattctgtttcagcagtattgcctgaggaatttaagctagtcaggtttttgtttttgtttttgttttaatccagatgattatttacgtttacatgtgtaagaggaaaagacccttttcttaaaggacttaattgctgtaaaaaggcctataattaatgcagtaagtgattttttaaaaaaatctccattttacaggtaaaagtaagtgattttggaaattgcttttgaatagaattcccctcccccaaagtcatatgtcttaaggacattctgatggttaaaactcaaggagagaattctgctggttttaccttttctacattgaaagagaacacttgttggcagtccgtaagcactagatttccttcatttagctctttcttgggggaaacaaagtttttacctcaagcttctcttgagttcctgacagattccattctccttgaaacaagcggtaactgaatattactaagacagttcctccagtgagaaaactgcagttggggaactctagccccataattgctttttcatttgggactcagcttgcttacaaagaaattggatgtttgggatttaaagacacacctccattctttgtaccatcactgatttaattgtcctgtcttcctttctttcctcccttctctcaagcaactctttcagcaagtgtgatttgaattaggcttgccatattgccctcttcaataacatcaaccagcctcttgaccatttaatccattttgaattctgaagatacttttgtgtggcaataaacttggttgtcacaagcttccttcttcccagtgtcatagtttgcagaaactatttaggaaaatctggttccttatgttcctagaactgtatggctatagctttccccttagaaatttccctatggaaggatggcttctattacacaggaatgctttctctgaatactgtgaccagagaatctaagtgcctgtgttgattttgaccaaattaacaaaatttctataattcatatcttttcgttttatgacaattaagtaatatttcatatgtgtcacttttattattttttcttttcaaccacacctgttttggtcaagtcatctcttactttcttaaactcccatacattcacatacatacacatttctttacacattcacactattttttttttttttttaaaaatacaaagtcttgctttgtcacccaggctggagttcagtggtgcaatctcactgcaacctccacctcccgggttcaacatattcttgtgcctcagcctcccgagtagctgggattacaggtgtgcaccaccatgcctggctaatttttgtgttttagtagagatgggattttgccatgttggccaggctggtctcaaactcctggctgtaagagatccaccagcttcagcctcccagagtactgggattacaggcatgagccaccgtgctcaggcctcaagatgatattctttatgaattttttccctctattttagctaaagttattatgaagtatcgatatattcactttaggccaaggtttccccacatagacactattgacatttggggctggataattctttgttgtgagggtctgtcctgtgcattgtaggatatttagcagcattcactacatgccagtcctaccccctgcccaagttgtgacaatcaaaaatgtctccagttttgacagatgtccccaaagttggggttggagagcaaaattgtccccagttgagatctactggcttagaatatctaggacctggcctttcactgaaaagatacaatcatttttcaatgtaaaccatatacacaattttcaattaatgcttgtaatactgtttgtatgtactatactcataaccttccatatacttcctattatttgaagagttacaaatagtctcacctattttccatgattgtgacatgattatatccaaataatccgtatgtctttacccaagccccttttacaagcattttctctcacaaagcaataatctataatataccacaaacagttcatctgtgtcattttttccgctggtctccgatctgttatgttatgctgacttgccattatttttaaagcagtgatgctaaactattttggataaatacctcaattgctttgtaactttcttggaaacattaaagatattttattttaatatttgggagtatttcttttctactaaggacttttagccagcattcctttgtaagatatcatgttctgatgatttatttgttaagtttaccctttcaatataaccgctgctataagctcgggatgcattatacattttcaagatctgtaggcccactggaattttgatttttttcccctgacattcacaggaatattatacagacagattttctatttaaagataactttgactttgtataaacctcactgtgccatttaagtgataaatattggtgcatgaactggtttgactttctgctgagaactgctaaaagccttttaatagaaaacaatagggaatgtcaaacattgaatcacgatctcactgaagcaatttttcttagaaagactttcatcacacagaagttttatccttgctcaaattttgccagaaattatgtctggttaaaatctattgtgatgccttgtgcagcttgtttacccaatcttttatgaataaagggcagctttttaatatgttaccagctttgctcttctctttcttttttaaaataattttcatacttaaatactaactagctttgaacttaatttttgtctaaagatatatttagggacaaaacagaagactgtaattttattttaggttaggtatcactaagagaggtggttaatggccacatgtatgtttaatggtatgtgactggttgctttgggagcaaataaactagaattcccccaaatgagccactcattttactttgtcttgtcaccagtttgtgccttctaacccaggccagctgtctcacaacagaggccacgtgaaaggaatgcaggctcggcagagtttagtcatcactgtaaaaaattgcttgaataatataaactactaggtttatttatcttagcattttcaattacaatgtgagctcagtgagttttgactaagccctacctttttcaatatattaggtctatttagaacagctaagaaggggaaatcaaaataaaaatcaaacagtaactggcttcatgtaagcgtagtctgcatgtatgaaatgtgaaaagtcccatttcacagctaaccaccattttggacttgccattatcttcctttcttccttctttttttcttcattcttttttatttctttccttcctttcatttcttgatagcagtgtttagctggtggtgatcctcattaattctcttatccttcaataactcgtggagaaatcctaaaatcccttgttttgatgccagaagcatgtgttggttactgaaacaatagtctaattaggctccaaaattagaacgttgcctgtgttggaccctagaaggggtagatactaaaaaactaacagatacacattgtggttagattgtgtgttgtattccttcattgcacactgtcatcctaattcagtgccttacatatagaaggtacttaattttattttttcttttatcagggtattcttactgttgaagtgaaaaaatggtcctgtcttcctctacttttagttttttcaatgatcgcaatatccatctcttcccagataaggataggaaatgttttatgtagcattattgtacaataccttaaatatatacttaatttaataaaacttaaaatgcattagaatttatcctctattggatggaattattttccttaataatttaatatattagttaattcatttactacctaaaaattcattaagaacgaaatatttcctataccctgtgctgagcactagggatgcaaatggatgagatgccattactatcctcaggaaagaacaatctattggaagagaagaagacacaaataactgtggtctggtgaaacaagacctatagtatagatagatacaatgtgccatggcagatagaggaagttaattctgttaatggcgatacagggtaggctgtccagaaagaagatgacacttgagctggtcttaaaaaatggagaggagtttgccagttaaaaaagtagcagtgtatattgctggaggtgataacatccattccacactgcagacagagcataagctaaggcatggaaatatttgacttgttgatatgcatgtcatatgttccagtgtggctagagcatcagtggcattgggacacttaaagtatatgatactagaaagatagacagaaccttgaatgcctattaatcaatttggattttatcctgacagcaaaggagaaccactgaagtgttttaagcaggagtttgacagtatctggtttctaatttagagagaaaattctgttagcagtattgaggatgggttggagggagaagatgtgggatattaaggaaccagttaggagtttactataattatttaggtgatggacaatgagtgcctggattaggacatgggcattgcaaatggaaatgatgacatatttcttagttatgttagacagaactttagtaaccacttgtatatggagaataaggagcaacagagaagaatgatcccaaggcttctagatccagccactacgaacaggaacacaggagaaggaggaacagctttggttaggaaaggtgatgttggaagtgtttgttgtaagattactgtaagaggttagacatttagaactatggaacttgagttcaagagagaattagagttagagacagacttgagggtcatcaccatatctgagatagttaaaagcatgaacctgagtgcaattgttcaatgaaagcatatagaataagaagagagcagagaagaaggaataactcggtgtaggggggatgggttttaagaagctggtagaaaaagagaagcagacaaagggatcaagtagttgcactacagatgtcataattggactacaggaaaaccagtgctgttgggtaactgatagaaaagaatgagcaggtatggaaggaatgagaagagagataaattaagaaagggagaaaaattgagagagaatagacttagattgaatgctgcgggaaaagagagagcaaaggagattgaaaaggagaaaggagtatgtatatacatatatacaaagagagagaatagtgagagggaatataactgatacagcaagttttcagatgaggcattacgggctagtagcgcagactgggggtaaaaaacacaggtgagaaagattcttgaaaaattaagaggacatttcttcctctgatgcgaagaaaaaggagtaagaataaatgaaaatagattttgaaggtatagttaagggaagttgagagttcaaacatgacgacttgatttctctatgaataagagaaaaagtcattggcggccatgacagtgagttggcctaagtgaagtaaggctgatactttatcagcaccagtgatagttttttgagaaccaacttgtgtaaaaaacatttataaatctgcggtgtaaccaatcagcaagataatgagggttttctcttgctcttggctgcttgtgagcagcaggaagagaaaaataaaatgaagcagggatggatgcaggattatgaattggcaggtcaggtgtggtaccaggtaagccgcgtagggacctgtgatcactagtgagggttaggtaggcatataagggaagttaggaagacactgatggactagcaactcagagacaagggatgtggttggaggtcttattgaggtttagtgggagtgaagaagtatattttgaagtctaattataaggttagagtcttgcagatttaagtagagagtctattatggcttaactaatttttataactaaaaagtaatgttgagtaaaacatgaaaagaatttttaaactcctgtgaagtgtgtaccagtgattagagctgcgacagcttataggaataagatcagaaaaactgaagctggaaatgaaatgctctgtgtgtctgtgtgtgtgtgtacaatatatccacacatatatactatagtatggtatatactatacttatgtagatatataagatatataaaatacacacatgtatacacatatgcatacatgtgtctgtgtgtatgtatataagatatgtatacacacatatatgtgatatatatacacacatatatgtgatatatatacacacatatgtgtgtatatataaataagatatatataaattagatatatatacacacacgtgtgtgtataaaaataagatatatatacacacacagacacatgtatgcatgtgtgtatatttgtatgtgtgtgtatatttcatatgtgtcttatacattttttctttcaactattttgagaaaatacaaacgtggaaaaaaatgaatctctgttaagtaaaaagccaaagattggacctgagaggtgataatggaaatttttagggactatggtcatattcttggtaggtgggctcagaattcaagattttaatatattgaagaaatggccagaaattaaccaaattttattacagcatgttttggggcattggggaggcaaaaacaaaccgtgagtaagggaagtcttgcatgttaatcctaaaccctttaatttttcttatacctcactagatatgcattctagtaacttagaatttaagtaggtcttccttattaataggagaaactgcaaatttactctacccttcactttatgtacccttaattctctctatctcagaaacatcttcatgaattgaactttatacctctattgacacacacaagtggttctaagcccagtgcctagaatatttcctagcacttaattagaaatgtagataaatacctaaataacaataaaacataatacatgctataatagagaaataaaaggaggaaatggtggtgcctgaaggaggaaatgaccaaattgtatataggtgtgttagtgacacatgtctttaatcccatggctcttaacgttgaccctcaaatccttaaaccccctccccagagtctattttccaccctggattctcccttccttatctccttttgccctcaccaaatttttccaccattttgcccaatttcacaataatctggtaaagcaactggtaccaatgagataacatattagtgtattgataagagccttctgaagggattgtttcaacccaaaggaatgacaccataaaatctcagatattatggcaaaatcatggggaacattatttactttgggtagacaggttgtctaatgactctaaagtcttatcacattggtgtttatcctacttacatgtaagactgaccttgtatttgtataaaatttatatatgttgcctagtaaaattctgttgatcatttgtgtcaattaaaaggtctctgggtataaaagttgtggtctgaagaggtgcaaagatttagttagttttactatcacggtttcctgaatcattatggcttctatgattaagaaagttttaaagcaacttgtaaagatttaactttgtcctatgccggtaaatccaaccttgatcaaactaactcaagttcccagctccaagagggcatttgttctcactgtgttttctgctcgatttcccccagctgaagtgaaatggatgaagaattttaatttgtcttttttgcattcaaatataaaaaagtcattggatgttagctgaaaacttatgaagtgacagtcttgttaataaagacaaatgagatggcttgttttattaatattaatgttgcacataatgtagctttgctaaataaatatatggttacattttgcaaactttgcaaattaagaatttatagcaattgtagattttaaggccaagttacaaattttcaggtgcattttaattgttggcaaatattttaagattggagaatcacttacatttatttgaaatatttgtgaagaaacttagcttacagccttgatgatttccagtatttgtagtgatgtcctaattatcatactacttatagcaattgagaactatggtaattgagaaggagaatcttccacaatctaatacaagtcaatcccactaatatgaactccataggggagccacatgttctggctgctgtgaaatgcttgcagtcccaaaaaagaaatcaggcccagattttctgtgggagatggggattaaattaatagttaatggagaaaataaaaaaattggaagggggaggacttggacatggcttcacttcactcattcattcactcattaaatatttatgagcagccggacaaggtggctcacgcctgtaatcctagcactttgggaggctgaggtgggcagataacctgaggtcaggagtttgagatcagcctggccaacatagtgaaaccccgtctctactaaaaaaaaatacaaaaaattaactgggcgtggtgggggaggggatgcctgtaatcccagctacttgggaggctgaggcaggagaatcgcttgaacccgggaggcggaggctgcagtgagccaagatcgtgccactgcactccagcctgggcgacagtgtgagactgtctcaaaaaaaaaaaaaaaattatgagcacctgccaggtgccacatcctgtgctgggttctgcaaataagacagatgaagtccttgtcctcatggttgttcgttacctccagatgtggatgctcctatgctcctgtggtattctgttagttgttttggaaacttggttggttcattatggtcaaagttccaaattagttaagatgattaagatgttgaggtgcagagaggggaggacagagggaaggagagttgtagctgaacaaaagagccatgaaatgcttagctgttctctctttgccatactccctcatcactgcctaattttcacaatgggttagcaaatgtgaagtgttctgtaggcagacatgactccattcaaagcttttcataatcattttggaaagtggcaggaattagaagcccagcattggcagcacaggaggtaagggtgatatttattatagaccatttttttgctttgtagtttatggagtaagctaagattacaactataattatattattcaatgtttaaattttatatattatcagaacaaatattaatgtgtaagagaggcatacaatgtgaatattgagccatctctttggattcattgaaaggttggttttcccaacttatatttataaatgacttaggaccactgataatgctaatgaatttagctaaaaagtatctccagaatgatactcagacattttgtacatttagatttattctacaattcagtggggaacaaaaccattcaaaaccattttattttgaataatttagttacttcttgttttcctaatgaaagaatttgctttttgattcaaaattattctggatcaatgagacatgagggacatctatgaaaaaataaaaatctataaattatccagatttttaaaatccatatgtttaatttcatagtctagaaaaaaataacatctagatttgactattttccctaatacctggaatgtatattttagataacataaaggtagatgaagtaaatgctatgttggtctcttttcagggaaatcttgtgactttttcaacattgtatcacaatgtcggaaaaattcatgttttataatctagaattttatttgccttgctttatgtagagaatagttactttccttttgtcagaatttctaatttctaatatctcttatgctagctgctattttggtgataggtgcttttaaagaaagcttcaaatgattgtactacttttacctagtagctaacattagtttccatgacagaaggtgtgtaaactattgtcagtcttgacaacatagaaacaagatcagctttactcaagaaagttttcatttaggttaataatattagggtaaaatcccaactgagtctatatcaggaaatcttttatgatctgatattataacacattcaagaataacaaattttcctttaaataaaattagagggagttgctttgaggctgaataaaaaatatattggaaaactgtgtatagtggagatatatgttcctgctctgttgggaacccatttatctctgactctaagactaatcatgttatgaatagacgtacacactctgggcaacttgaaaaacaatcagtttgttcagctccagaaggaccctctgagatagatttcttgcctgaaaaactcttgatttgactccacctttttatgagattatcaaatatttttacatgttttgcttttgcatgtgtatgcatcccatgatgatggttcatacttgaattgtgtttattgttcatattcttttatctcattttttcttcttggtacaccatgtcaagtattactgattatgaacagatgctgtcttgatgggccgatttaggggcctacatcttatttccaaagggcttttgcatactctcactgctatttcctttggataagaattttgggactatgtatagacagcatacatgacactgtgatacttaagatcagttatattttcagatggcccatcttatccttgttagaatgacctgaagctttgtggttttagctgtaccaggatgagatgcctagagatgtagaagggtcagacttcagtagaattgcagtccaggcttgcctgtccgtgttaatggaaagatgtcatgttgtatagcagtggggtttttcagcttttttttttcaagaagaaaataatgtttttaagtaaaattttctgtagaaccccaatatctacaacaattaagaatatggagttgcccaaagcagagaaagagctgagacccactctctcatctgctttgccttctgctaggcctccttgtcaccccactccgtgacccttcaagaacctctgtggagtactaaagctctgaggaatgaaattgataaccattgtggtacgaataatttttcttttttaaaatcatcgatcattgactgaaattttttaaaaactgcatttcaaaattggggtgtcagctatctagggaaatcatgtcagttaaaataaaagcagtcccactatccaaactggaatgtcgaagaaacaaaaaccttctcatctttaccaccctaacaaaaaattaagcgtaaaaagcaataaaagttcaagtaatttgaaagccaagttgcatagcccagcctcttatttgctgtgtggatagaaagtgaactaacatttgatgaatatctactatctgaaaaaccttctgtcatgtgcattatatagtattctctaatttaaatctcacaacaatcctgggaggtggaaattattcctattttacaaataataaaaatgtggctggtggagataaagaaacttacctgagatcacacagctaggaagtggagggtctgggttctgaaccctaatctggctggctcaaatgctcataccctttctccagtcctgtgctatatttccagaaatatagtgaagggaagcaaggatattatgaactataaacacaagattgtcctgaaaaatatgtatagagatgcacttgaccacaaacacagtgtttttcatttgctgtttatataccactatatctgtgccccttccttttatatgcaatatatttgatatattcttccttcctcattcctcttctgttatgcttctctcctttcctctttcccttctctctctacttccaccttcactgttgcacagtcttaagagatatgggtcctcctctcatctagacacggtatttgttggttttaagaaatgaaaacccagttaagatagtaaagtgagaagatccttaaaagaatatagaggtacctcacagaatgcaggggcaagatgtaactgccatgccaggaagtgaggtggcttttctacctctctgtgagtgcatagtttttcttatgtctgcttctctcaaatggcttctttctgcacatctgctcttactccctctcacacctctgctcctcttaattggctccctctgcttaggaatctttagcattgctcagtatggatggcctggccctaactctgcatgggctttcagatccagtgcctggaactttcttccatatctctaagtttaatgtcttgtgggcataaggttggctcagctcagcttataaatacatcctcttttgcgttaggtgttcaaccctgatccaatcagctataatggagtgacaggtcacaggttcgaatatggtcccttcagttgagattataggtagggcctaaacccaaagatatgtctagtatactttcgtcaatactggactttacttccagatatactctccttcctttaccctaattactctagagaagaagggaaggagggagccctgtgggtagcaggactttctcctacaaaggaagttagattgttccattcagggcttgtggtggttgatgtgtttagctcaaccagatttggacatcccagagtgtggcagaaggctcagaaacctttgtaggaaatgaagtagaaaaaatattacttaggtaattacttttgcaacaacttttaaaatgtacttgataaataatattttacatatttataggatacatgtgatatattgttacatgcatacaatgtgtaatacacaagtcagggtacttaggatatccataacctcaagcatttatcatttctatgtgttaggaacacttcaagacttctctcctagctattttgaaatatataatacattgttgttagctagctatagtcatcctactccgccatcaaacattagaaattattccttctgtctaactgtatgtttgtacctattaagcaacctcttttcatccactcatccatccacccacacacccttcccagcctctggtagctatcattcttttctgtacctccatgagatcaacttttttagctcccacatatgagtgagaacatgtgaaatttgtctttttgtgtctggcttatctcacttaacataatgacctccagttccatccatgtttctgcaaatgacattttattcattttttatggctgaatagtatttcattaaaattttggattagtatgaacaacatgaaaagcctttacgatgtggcacagtcgcgttagacatggatcaaaaacgtaggtgtagttcaccttgcctgaaattgtgttacatgtacaagtggtagaaaccaggtttctataaataagatgtgctggatgctttgtttctaataaactcatccatgctcaagagagaagtatctatgatgctgttgtactttaatgcccagtaatatattacgaaagtattttaaaaatcacttcaaagatcatcatcaaaggatagtgcagtctttgattactccttgaatactctctctctacttctctctctctcattctctgtctctctctctctctctctctctctctctctccgtgtgtgtgtgtgtgtgtgtgtgtgtgtgtgtgttgagggcagctaattgcagtgtgaacctgaagtaatgcttttattataggctaaagaagtgatatcaaactttgtctctaggggttatgatttgagtagattataagggttatgatgtacaagaacttggttgaaattattctagtatgcattattccaggcttgatgtatcatgttgtgatatagcagctctcaattttgtaaacagcctaaaaaggtttctttgggactccctagccatctcttattctggacatttaactaagaaagtaaaaaagaagttcataatcaccaagttcccaaacttgtcaatgtatcattttcaggttgaagagtttttcatggaaatgctttgcttctagacaccaccccttgccttctgcacaatatcagcagatgtggtggtagcttcgggagggctaacccctctgtggttgctcaagtttttcaactttagagtcttcatatcttatgattcccctatacttcacggatgatgacttcttgcttcattggggccctccctgaccactctatctacagcaaacttcctcatccccccattctctcacttcatattctgttttgttgtccaaattttacttattacaatctgcaattattttatttaatcattttgtgttttattgaatgtatcccccatcagattgtaagctctgagcaggcaaggaccatatctatgttagtcaacattggtatccccagtgctttatacagtgccttacatataaaatgggctcaataagcattttagggattggtgaatgaagaaaacagtagtagaacactatcatccatgataacaaagcagccacagaagtcatttcactttggaaagtgaacctcttggcacaatggctgtgtctctcatgtgcacatggttagtataccagtcatccctggagaaagggatgggggattcgggcaaatcatgttatattagaagtccccacacctaccattcaaaatgaataattatcaatatttaatatacttaatagaaaaatgtccctattttaaatgtgcagactggtgatttttcatacaatgagcatacacatgtagccagcacctagatcaagaaacaatattcccaataccttggaagctcctctcatgcctgcttccagtcactgtttcttcaaggttaactattattctgtcttctaacagcatacattagttttgcccatttgtactttatataaatggaagtatacagtttctattctttcaacattatgtttgtgagatccatccatcaaccatattgtggcattccccacacttaatgtttttaaacaagtggaaatgaatcccaagacacaatgagagggcaacgtaatgaggaaaggaggctagttatatagagtgatgattggagatttatgtgctgaagtgagccatgttctattaaattcactgtgccttctttgcttcctctagccttgcttcccaaatcctaaacattcagcttacaaatatctgcccttgggaaaaatacttactaatccaccgaaaatccatctctgctactgcagaaaaaaaaaaaatcttttgagcccgtgctgtctccctgaggtgtgtcaatagtgccatttctttataccaggggcagcatttaattattgattctcaatgcatatgtcctggaggtgtttattaatctgagtttagggacattgttgtttccctctatgtgcatgaatttatgagaagacctataggggaggggtgatgaaaaaactgattaagtttctggactttacacagaaagggatacaaataggatactatgcatgatttaaaattggcaaggacaggcctccagcatgagggaatctctttgagttattaatcatgagttatatatttttgtgacagtgaaagggagctttaattaaacacaccttaataaccttcccttacaaaattcctttttaaaaataaatatggcatcaagtaatatatggaaggtgtagagtaactcttctagagttctatataatggagaagcaccccctgacaaagaaggttgccaagcacttgcacaaattactaaaaaaaggctggggaatcactggccatctgttcagcatggttctcatgcaagtgtgcctggagccatggggctagatggcatgatattagaagggaaagatcttttggttttcatttgatgattatcaggtttctttaagtctaaaaaatgccttaaaacttaagtaataaaagaaggtgttcttttggctcatgcagtgtgtcgatctctgtctctcccaagcatttttagactttatgccagagaccacctggaggcaaaagacaccatttatttaattccttccaatactagtaccacacattaaaaaaaaaaaaagtattgtgctgttgcttgcgtaaagagttattatttactgggcctcattttaaaatgtttttattgctttttaaagtggtcaaaatgacacttttaaaacccacaattttgtgtgacctgcatattgaaccagtccagacaccgcttgaaaggtctttgcaggccactatggctccatacacaataataatcaatatcacttagactacttattgggtacacactgtgtgccaagaactggtaggcactttatatacgttatctcatttaattttctcaatgatctggcaaggcaggcacaaccaccactccactaataaatgagggaaatgagtcttggcccagtcagataattagtcctcagccacattgctcatttgttcaagcactgaattatgaactcgggtctgtctgactccaatgcccacattccttccctacaccatactttcttaatactttgggaaccgtggtctacactcatttcttgatatctgtgggggattggttccaggaccccatggataccaaaatttgagtatgttcaagtcccttatacatttgcatataatggatgcacattctcctgtatgctttaaatcatccctagattacttataatacccaaatacagtgtaaataattgttatactgtattgttttttctgtttttttattgttctattgttaatttttaatttcaaatagtttcaatctgtggttggttgaatctgcagatatggaacccatggatgtggagagctgactatatttcaaataagactctgaaacaaacacaacttctgatttggatatctttctaggttcgtctggtttgttttctggtcacttttaacatagtagtaatcagtactaggtttgaaccttgcctttgccacttgccaactttgtgacctgcagcacgttacttaacctctctgaggctcaggttcctctttcatgaaatagttaaaataatagaactcacttaataaagatgttttaagaattaaaggagatgatgcaagtgaaagtatatatcaaaataatagcgagtgtgtagtagatgtgcaagactattaataacaaagatactaggactggtttttgaacttagagcaccttggcagtgtctcttctccttcccagtaattaactcagttgctctcttagaagccttttctgttccatcaggatcagaaaacgtttccttacacccagagtttaacaattgaatccaggctgtcattacaaaataaatcttgattctcatacttcaatttttagcagcctgtcttctcttccttaaggtctaaagaataaccataaaaataaaaacgtgattctgctgagacagcattagaaaaaaataataaatgaaaactaaccctaatcaaaacaaataacatatatccaagcatctcaaacctttaaaatgttgtaaaggtagaactcatgtctatttacctagccctatgattgtcatatgttctaaaccaaaaattaggacacatagtccaacaaagaattcattttcagatttgtattctgatttatagaataagatacatggaagcataacaattaagttgcatttagctatacattttctgagtcatctttattgagaagaatatgggacactataaagttgaactatcctaaagattagggacatgtgatactctacacttttcttttgaataaaagcatatcagtaatctttgaatatccttgaaaagtaccaagatagaaggttattaacattcattgcaatgttaataactttattccagaattttcttttgtttctgttgtataacttcacttgtagaacacccattaatgcaataccaagcttatagaaacacatgctttatgtaatttttagtgtcggtaaaagtgatattcagagggagaaaagataattagccccagggtttgatagacatcatttagtagtcatcctgttaatctaaaatcctacacataaccaattaaccattgtaatgagaactttaatttttaaacttcctatccaatttctttcaatcattgctgccaagcatttgaaagccagtaatgcagaaggtgctttataggcctgtgttagaaatggtcacatccccagggagctaaaatcacaacagatcacacaagtagagtgatctgctttttattgtgggcattagataacttcagctttgaaaaaagttgtgttaaggatgaaacccagcaacttttagtgataaaaaaacattttgcaaccattgttcatagaatacacacccaaggccatttttttccttgatcttttgaaagaaattgtactatctgaaatgaattcagataaaggagattgaaggcagtggatgttcataaaattcttgtttggatgtggcaggtctctgggtggtttttgctgtttaggaccttctctgcttctctcccatccacttttctcttgtacctattcttaaagagaccaccctgttagtttagagtgattcatttatactagtggtgaaaaggcattttcatccactaccatgaggtactattaatctactgggccttcataaatttcattgtgaagggacttaatttgtttctattatgagaacttttgagcacattcagttatcataatcaaaaagcacttaactgcatgtgtgctgtgccaagagaattacagagacacattttcttccctctgagtgttcaaatttagcagtgactgccaggttgtgtggatcactgtgtggagggacagaatgatgcatgatcttggagagcaaacttggggctaaaggtatcaggccaaaccagcaaacctgtgtcataattgggagtttcggggaaactagtggttgatgtgagaaatccagccatgctggaggcacaaacagaagcccagtttggtatatgtagactagagaactgcatccagaggattaagcatggtaagagggtacaagactggagtccaaacatacaagcaacttggtcaggattcatttcaggcaagaagaaaccgggaatagagttttagcccagattcaaaacaggtagccatgtcctcctaattacacagccatggtgaaaaatctatattccttcatttgcccctgattttaaacagcctttctcttgtatttggatctggaatactggtttgggctgcttcctcaggtgaggcaggctgctgcagactatgtgtattataacatatactgatacactacagtgagctcttgtaatcttacctttatcttacctttgagacaagattaatatgaacaaaacacttattcaaaggtcagatgatatctagtgtctggggtgtggttgcagtatacatggaccttttcttagaactccccctttcttggcaacgaaatacaaaaatcaggctgacttccaccaaagcagcttttaacatttacaactgaggaaaccaactgatatctaaacagaaggttttttccaatcttttcatccctaagggcaataggcttttcagaaaggcaccttggattgtggtaaactccaatgatcagtaaatctgtccattggtaagtatgaaatcagcccgtttttaaaaaacaatttccaatttttatttatttatttatttttctggagcaaaggcgattattctcttagttacaggacttcatctggacctctagtttgatgacagtagccactatactggtctcaactgggacaaagatactatttctacatagtgtaaacactgacctgataaatagatactactgctcttttagaataaagccaaacataaaccttgaagtaagtgagaggggaggagacaaggactttaggggatgctttaaaagctgctaatttctcttgatgccattattcctctgtgcatgcttaaaggattatcttgatgttggagtaatgatccggagagtatcgtttgtaaccttgggggtagggatggggtgatggggaaactgttctaaataaactctgagacagtcagttcaagaagaaaattaaggctacaccttgagtttgacaaattaagttcttagtgatacttgaagaattaccagtggcctatgttcctaagaaaggagtaagaaggccggacacggtggctcacgcctgtaatccctaaaggccctccctttaggaggctgaggtgggcggataacgaggtcaggagattgaggccatcctgacgaacacggtgaaaccctgtctctactaaaaatacaaaaaaattagccaggcgtggtggcagacgcctgtagtcccagctactcgggaggctgaggcaggagaatggtgtgaacccgggaggcggaggttgcagtgagcagagatcatgccactgcactccagcctaggcgacagagcgagaccctagaacttaaagtataataataaaaaaagaaagaaaaaaaagaagaagaagaaaggagaaatgggagggaaaggcactcatcagttaggtatattttaccttcataataatgttatgagtgtgtatacattatcatcttcattttatagttgagtaaaccggagctcagagaggttaaataacttgtttaaacactgtagttaagaattaggccctaaaggcaaaggcaggtgagcctgtattctggcttcccctaatttctaccagtatgactttgggatagctacttaaactttctgtgcctggtttccccatcaataaaacagggacaataatagtacctacaatcaatcataggaattttgtggatatttaatgagataatatgtataagtcacttaacagtgttccagacaccaactactcaaaaagggtatctgctttgtagttatcaccgttatcagcgttatccttaccccctctatccagatgtgtcagacaccaaagcttatgttgtttctacaacattatagtgcctcctagtggtagcaagagtggtggagccagagaaagtcaatgtgcataagtagaagatgaaaagataaggccatgagaaaaatgagaaaaggcaaaatttaaaaggaagataaaaggagctttatactaacaggtgtaatcactagaagctcacttgtaagcagttgtctcagatgccatactcagtgtatcctgcactagaacaaccctttctctctgaacccctgaggttactagattgtggagaatagaaccccatgtgaccactcaatgagactcatggagaggctttcattaggctttgtttgagaaagccactatgtagagctcatctaatagatctgaaccctaactcaaagacattttcaaactagttccaaggccatgcacatgcaatgaaaaacacgcttaactgtgggatacagggaataatcgatcattaaagtattaattaaccaaatttattgaaaattgaaatcaccccaactgtcaaatgagtcatgctccatggactttctgcgttctaaatattgctcaaatcatgcaaatgttgtgtgaaactgttatgttggccgctttaatgcaatttcacctcatttacatgaattttgatgttgcttagggatattcaatacaacagcacccaacaaagtactcaagtatgtacaaccattggaagagtaatgactgtaacatgtctagatgtacaagaaagctagcttcttataacccagattgagctaaattagcctgatgaatgcatttcccctgctattgttggtttgaccttcatttcaatataaaaatgacagaaaataggaccctttttatttgtttctctagtagtcatcaccatttctactgattcattgtcagtccctactccattcttcaaggcaatcagccaaatgcctgccaccagagaaatccctggttccaagcttaagtcaccttcataagtactgaagtgcaacatacaaaactattggacagcagttgatgaggatttaatcctttttggacaggtggcacttttaagttctgggtagaaaattcccacattttgagatctggaattttgacctggtagagcagctgataccttaaacaaagcagtgttctctttattcactaggtggcaggagctccttaatatatatgtgagggatggctataaacacatgtttagactagtgcatcagtaaagctgtcttttagagacagatacatgaaaatgtgagccatgaaatattaaaccagagcctatgagaaaagaaatcctctgtgttaaccacagtagcttaggatttaatagtagtagaacaaggtgattgtttctttaaataataacaatttgaagaaattccattagtaggtttgtcaaaatgaagtgaattaataaaatactttattcctatgtgttttgctgtttgaaaatttacttccttcaagtctctgctgaaatgtcattttatcagcaggggcttaccctctcttatactccataaccctctgatgttgctttgttttactctacagtacctattacattctgacatactttatattttacctgcttttttatttaccgagtgtctcccctatcccctctggaatgaaagctctatgggaacaaggactttgttttgttcattattgtattcccaacacatagaacactggctggcagataatgggtgctcagtatacattcaagtgaatgcgtggaagaattaccaaaaggaaattatttttaaaagataattttaaattcaacttttaagtcagcttgtatataaagccaagctgatttgtatataaagtcaagctgacttaaaagttgaatttaaaattatcttttaaaaataatttcaattataatcaaagtaaatcatattatagtatacatattttaattttgttttgctataatcataaaatattaaatactatcatcacctaaatggatgtctttatgttaacacttgatggtatctaaggtaattaatttttaagtaattatgccaaatttgcctgctgtttttatatcattaatcaagataatgaaccttgtcattgataacactatgatttactagtattttgctctttaatttcagtttttacttctgttttgagtagtagtataatattttagaaaaataaggaattaaaatggtgataaaattaggtgaatttagagaatgcctgtattgttatttttaaaatatccaaactgcctctacaagtacatctttgaagttttggttgtagcatggtaaagagaatcttagcaaccagataacttttgaaaaaacactgaatgtttccaagcttcaatttccttatctataaacacaagatagtaatttctgtcctgcctattcataggattattgagatatataaaaattatctgggaaatgtaaaattctattcaactgtaaggagttatagatgatgctagtaagtaatttaatttgtctaatgattttaggagctacagcaatcccactcctaggtatttgctctgaagaaaggaaaccaatatattgaagtgatatctgcattccaatgtttgttgcagcactattcacaatagccaagacttggaagcaacctaagtgtccattaacagaagaatggataaagaaaatgtggtatatatacataatagaatattattcagctataaaaagaatgagatcctgtcatttgcaggaacatggatggaactggaggtcattatgcttagtgaaataagccaggcacagaaagacaaacttcacatgttctcacttatttctaggagctaaaaattatagtaattgacctcatggagatagggtgtaggatggttactagaggctgggaaaggtaatgggggtggggggaagtggagataataggtataaaaaatagaaagaatgaataagacctagtatttcctagcacaatagtgtcactacagtgaaaaataatgtacattttaaaataacataaagagtataattgggttgtttgtaacaaaaataataaatgtttgaggtgatggatatcctgtttacccttatgtgattattatgcattgcatgcctgtatcaaaatatctcacgtaacccaaaaatatatacatctactatgcacccaccaaaatcttaaaaagtactttgtttttaatactctcttgtaggactttggatatgagcgctgtcttagctcaggttgccataacaaaatacaattcactggatgacttcaataacagaaatttatttcttacagttctggagtctagacgtctgagatcaagtttccagccaattgagtttctggtgaaggtacttgtcctggctcgtagacaactgccttctcactatgtctttacatgacctttccttagggcttgtgtgtatagaaagagagacaggagttctccagcatcttttctaataaggtcactaatcctgttggatcatggcatcacccttatgacctttttaaccttaattacttctttggaggccctatctccaaatatagtcacactgaagggtagggcttcaacatatgaatttgggggaaacacaagcattcagtccataaccaacaccaacagcatcagcacaataatgttcataataactttttttgagcactttttttgtgtgtgccagttactgtgataagtactttaaatgaactatctcattgtttcagtcagttatttctgtggcttatcacaatcacttgaggaccagtgagaggggcttttctccatgtaattatttaaaacctaggctctttccgtcttgtggctgtggcctcctctgagttctagaagttctttctatttagccggtgaatgggaaaagaaaataaggatagcacatgggaggttttcatgggccatgcttagcagtgccacgtgaccgtttttcattagcaagaatttagtcacatggctatacctaatagctgagaaatgcagtcaacctgtgtgttcaggaggaggagaaaagggcaatacagttattagtgtagcattagcagtaactagcatactcatttaatcttcatagtaatctaaatcggtaggtaccatcattgtccctattttaccaatgaagagaaggtatttgctcagtgtcacactactagtaatttaaattgaaactcagtctccttcagagggttgcttttaatcactgtgctcttctttctgaactaggggtaagagtattatttcattgctatagtgaatgtttgaaatgtttgaccatctctcagagatgttttaatagatcaaaaattttgtttagttataatttgtttagttactaaagaaagaagggaaagaaaaaaggaaggaaggagaacaaataaggacaagctttttgtggaggggttggatgctgtttcttatatgcaatcatgtatacttgttaataccattaatagcttattcacctttagggtctttttccttattgacataatttttagagatacttcgaatgtgtttagtgtttggctgtgacatcaaagtatatggagtcctttgcctgtctctgcctaactacctcttcataagggaggttgtactgtccagagagaccatataaagtcatcttagaatttaaagtcatttgtccatattgagcacaaattggaaggtcaaggactaggatactgcttcccattgggctaaaggattcctgaagtgatctaaaacaggagggatgggaaatctcccttcccttttacctaagtggttacaggactaaactaaattacagtaggttgccacttgttttttgcatcttgatgggttttatagccacctggatggggctgcctctccaatgtaccatgttgaatggtgcattgtttgatttacaatgttcaacaaacatactttcttaaatctcttctgatattttagttgaaagttcattttctttttatagacagcacaatactatcctaattctagctaagttatgataacaaactacagaatatgaacttctaagcttctaaaagttatcttcataccattcagatggtatgcttcttaaaatgccaacatattacaaagaccatttaattcagccttcttgaagcacaagaagaaatgatctttctagcaaaactgttttcctgccatactaagtcgaatttctccaatactataagagttctggtagcttttgaaaaaagtagtagagtgggggataaactgtttagacagcatgaaataacttaaaattttcctgcttatattgaagagagtagcaatctaggatagtttcatcttaaaataaatttgtgttctgtggttgatagtaaaggggtagtagggaagtgcccttgactaacttgttccattatcaaaagccaagtcaggatttttgcatgtgcatatataagtggccaaatgagagttcatagacaatgatattacattcggctttcttccggcagtgttgatagtaataataatacggatcaggcctgtcttaccaatctgaaacaccctataatctgaaaaaacattgaaatcagacgtgtagaactgaattagagatgtgtgggtattaaaatactccatccaacccatttccacatgtaccatctgttgtttccagatgcactgcttcctagaggcagtattcatgggcatggcattataacaccaacaaatcggcatttctacttctgggacttaattcccagaaatacaagttttcattggctgcacttcagggaattagacttttctgtggctagggacatgccattacaaccatggtaatggaaatagaccaatttagagcatataaggcagcagggtgccttcaaattggaagcagtacaaagtttctctgatgtgtctgtaactcaaggtaagttgagtaacactattaatgttccccccttggtacttagatatgcctagcacattgcagataagttgttggaggtacctcttctatgttaagtttgataagtgaagttataaaatgcttcaaaggctctggagtatatgcttaaagccatgtatatagtccagcaccttaatctgatgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacaaaaggagtcttcctggaataaagtattttcaaataaatggtaagataagtgtgataatctcctagactcacattacacataaattagtttgctatgaataattatttccaaaggcttagtgtgcattgaagtaaacgtttagaaacagccagtttgaaccatttaaaaaatatattttggtttaaaataaggaaaaaagaaatgctttgggactagcatatatggtcatgatggagtttatttatttgtagccatagtatttgaatgacatcttttgatatgctttaaaatttcttgttggctggaaagtaaagaatcatgactacagatgtcaagtttaactgccttcctccaaagtgagtcaaacgattcttatgatgtattgattctataccactaagttactaactatgttgtgggaggaacctgcctcctcaagatagtgcagctttacatcagacagggacatcaaggtcgtcatgaaggggaaatttaagacatggaaataactagaacagctgggcaaggttaaagcactctggcatgcactggcgaaagcagggcagcaaagcctgcgtctgtaagcttccagaagaggtgaaaaatccaaagctttggaccacttttctgcggaaaaggtaaagctcaaactgtcgtattggatctgtacatgctactaccttattttcttgaaatttgaacttgagacaggtaagaagagtactgactcaagtgtagcgagaggttatttttaataaggattcatatttaaaagtttagttaatcataggactggacttccacagagttaaaaaaataaattctaaatagtaatttttaaaaatcatatttggattagatgtaaagtgatctggggctgtaatggatatttgtttaaagttatttcttcactaatctgttattagccaaacctgatgaggtcatgtgtcgatttattggcaggatcaaaggaacacatttatttaaggtggtatatttgttgatctcccccagaattctctagatgtgagttgatgcaattcaatagctattaattccactttaataatgagtttgacatttatatttttacaatatcttaaccagccttttcaataacatgatccaatgatgcagaaatttgtttctaattgtacaggccatcattaacattgttgtttaccctgaaggcatttgaatgcccttttgaaataaaagttaagggctattttgacctagatctttaaaaacaagtaacacttttatgcaaggacactggttaaattgtggggtgcagacaaaaatattcaccaactgtcaaaagaggctgagaagttatttccactccaaaacgtctgtaattcactaggttagacaaagaggcacattcgtgaatcaagggaattgttttataaaaatgatgttttagaaaattgccttaacatcttacacactttaagtttggaatcaagaaattctgccttttacttacctgtcttattaattgttttaaaatactgaaaatatatacatatgcatcatggatggcagaaaacacatatgacttggcatgacagttgcttgaaatggaaaagcaatacaatgactttgtacttttatgaaacacatagattggtaataaagctgcttcctagtcgcatttggtcgccacaacacccaagtgatttgtgtaattattgttttatctatctttttaaacagtggaaaagtcagatgaaccaaatgacccagtgctcatttttattgttaccatccttctactagatgtacagtcatagtcatttttaaaagaaaatcctgacttttcttatcatatccaaaaagcacgtcactaaattctcatatcttgtgacaactgataaataatagctagagtgtattttttacactaattgtgattttaaacaacattaagaattggttgcttatatggggtaagttgaaacacatagataagcccttttaattgaatacttggaactacacaattccaaattagtcatgtaatattttaagaagagaaagatacacgcattgggtgccttctctgggccaaacactgtcacacatgtaatggcaacttcagaacaacagtgtgcagtagttatttttatccccatttttatggaggaagaaacccaacctcaaagatgttaaacagcttctccagcatcacaccagctactcagtggcagagccaatattcaaatgtacatctgcctgtttttaacttctacattacaaagcatttaaataaatgtggaaaatatgttcgataataatggctaaatcaaaatgcattggagtaaatctgtgtagtactgttcatcaaggtaaaagtatgcattttgtttgttaaattgttttatacaagacactggaataaattaaatgcatgagtgatatcagaatttaaagcattgtgtttattaatgttgttttataagttacaattatttaattgaggagcagtctacaaaaatatttaatggcaaaagtagagttaagttatttgcacccacacattcataaaattttgttttgtttttttaagacagggtctcactctgtcacccaggctggagtgcagtgatgtgatcatagctgactgcagcctcgacctcatgggttcaagagatcctcttacctcagcctcccaagtaggtgggaccacaggtgcacaccaccactcctggctaattttatttttattttattttattttattttatttttttgtagagatggagttttgtcatgttgctcaggctggccttgaactcctgggctcaagtgatcctcccgccttggcctccaaaagtgagggacttctgggggtgaaccaccacacccaaccttggtttttaaagctgggatttctatttttcacaaccttatttataaaacaagccaaataccaaaattgaaaaatgatatggcttcatttgaactatctgttgctatgtgtaaggaccgttaaagatattctggtacaaattactctttaaaaagagggcttaaattaagtatgttcagttgtgtaatgtacttttggctttaggttataatgcaatcagttattttgctgtgattcaatatttacatgtttctgctgaagaaaaagcccagtcactacagaaagaaattgtatgattctacatgtgtagaaatcttgtgatataattgcattctcattatgtcttctactagtaatttatgaatattcaagatttttattttatttactttcaacccaaatgatatttttttctgcagaataacagaaaaaacttaaccctagaaatgactgttttttaattaaaaataataacccttccagaatatagagaaaaataagtttctacttattcaccaaataaataaatgctgactatcataaccctttaagtctgtatgaccttgtagttctataacctccctgaacccatagttttcttaactatgaaatgaggtaataactacttccctgggttactatggttgatacttaaatagtataatgcatggaaaggataaagaactgtgcctggcaatgagtaggtatcaagttgttattgaatcagttaatttgttgtgcatataattaagcaatttggaaatatgatttaggaacatcttataatctgacccagaaattgattttaaaaatgaatgaaatttcaattacagtgaagttgcttatcagattcccttgatagcttccccaatattgatcgaaatgatctagacctctcaggagcaccctccttcactaggtcttagccctatactccctctcttgtgttttactggtttccttctcacagtaaagcattttgatatgggtgtttaacatgactattttgatggagtcatattgacataaccacatccaaatatctctatattaaccattaatatattaacaggattatattaaccattaatataaaaccattggccattggtttctttacccaaggactgtgtatcatatcagacattttgaacttagttccatctcttagtatcccccagcagacttcatggttctttcactttctactttacccatttttgttttaagagacagggccttactctgttacccaggctggaatgcagtggcatgagcatagctccctgcagcctcaaactcctgggctcaagtgatcctcctgcctcagccccaagagtagttgggactacaggcatgtgccgccacacctggctaatatttttaaattttctaagacatggggtctccctatgttgcccaggctggtctcaaattcctggcctcaagtgatcctcctgccttggcatcccaaagtgctggtgattacaggagtgagccaccacatccggccttacccataattgtattgcttgactttttattaaaacttattgcttttgtagtcataaaaacagaactcttttaaaaatgtttacaactgagtcaacctccaaggggagggatgctttttacccaaaaactaggattgtaaaacagtgttacctcatagtgtatatatgctactgtagaaattgttagagaaaattttctcataccccatccccagtgtcttacgagatttgaaaaatcaagaagcctacacaaataagtagccatttaaaaatattttctactggaaaatgggacaaattccacaattacattgctaaatctgtatttcagtagagattaaataagtatggcaattgtaaaccttaagagattagacaatttagaatggtgaccattcagccaacaacataaattatggctgctgcccctttgtgagaaaatcatgtgtgataaacatgtggcccctagttttatgtcgtgtggatgccacatggtgccttatcccaacctcgttccctaccccatttctgagcttcttgtcatttcatagtcttctggtatatagatcagggataggatgaggtccaaagataagaatgaggatgtttgtttcacatactgcttgatttaaaataatctgactataaaccttgtcacgttatcaaaatatcaggtaccctattccattctttgctgtacacttgtctcctcttgatattgctaaatcatgaataataaagaatatctattaagaaatgtgcttttgagactaaaagttaaccccactttaatgataacatgttggaaaatacagtggaaaggctagaacatgtgcagaggataccatttactcatgccataatgagaaaaatatgaccaatttggaggggtctttgtgtataaaacaggtctctttgcaagagacctgttcaactatacatatatgcagcagtaagcaaatatttgagtgagtagaataataatagcaagcaccgatgtgggattaactggtgatatattttataaggccacgttcatcatggtatatcccatacaacaggcagatgttaagatgatgtcaataattatgaatttgttgagcacccatgagtaatttgcttttttaacataatggattgaacacattttaattcttgccttttaaaggcttccatatgaagccttctaaaggggatcacataacatgctaacatacaagtgattgtaaagaagaattagttttgaaaatgttgttcagataagaacacatggacacagggaggggagcaacacttactggggccgtgtggggggcaggttgggggagggcattaggtaaaagagctgatgcatgctgggcttaatacctagctgacgggttgataggtgcagcaaaccatcatggcacatgcttacctatgtaacaaacctgcacatcctgaacatttacactggaacttaaaaacatacatagttagaatgagaatgacatgaaattcattaaggttgacatttaaattcatgaggttatcaatgcttatatacttattaaaatataaagttgtttacggtaaaaaaaataggaaatgttgttcagacaagtatttaaatattgttagtgcgtaggactgatacagactgggttaatctggaaaaagtctcttactcaagggaaccttaaggtgaactttctgggaaaaggttatgttatttagacagacttttgtagtagaagtattgaaggctgctcaaggtaccccacaatttatattattttcttattctagagaggaagagtgttgtcataaggaaaagttaatgaagaaagaccgacgtaggatttggttgagtttagtacatgctgatactatggtagcactgtatcataaactagtactataaagactattatatactacccacgcaattataagatgacacccattcatttccattttcatcatcttcattttttttctaggatatttgtagcttataaaataggataacctgattaaatttagtcctttgaatcacgaattctagattatttcctttttaattctgggagaacttaagccatctgttgccttgaagcagagagatttagtaatcaggcagagcagtaagaagatatttgtctagggatattattaattaacaaacttggaaggtattcttcattttttaccttaaagtcaaagtacccccaataagtacattggggaattaggctagaaaacctgtcttgggtcagatactctttgtgttctgctttgtatagtgcagaagaaaatgtaaataggtgttgggtccattacgatgaaaaaaaaaaaagcagtaaataacaagaattgttttttgtgaggtcccaaaatagtgcacatttataaaaccccaatatttcaaaacaaatattatgttgtttttacataatccttttcacttaaaaataactgttctcaccacagaggtgataactgtttaaggtgatggattttttgattaacctatttgatcattacatcacattgtaccccataaatatgtgcaagtgttgtgtaaattaaaaataaaataaaacattaaaaaagctgttgtagtgtcctttctacttaacttccatattaaaattgaaaatttcaacaacagtttttgaaggaactagaacaagtttttttaaatcaaatttatttaagtacagctattttgcaattaaatggacccattttaagtgcatacactgatgagttttgagaaatatatatacacatagagtcaccacactacccaacacataggatctttccaaaaccccatgaatttctcttctgcctcttcccagtccattctcattatcccaagcctcagggaatcactgatatactttctgtccctatagattagatttgtcttttctagaatttcatatcagaggaataatacagtatttacttttttacatatgagttcttaacactcagaacagggtttgttttggttttgtttcagtatcttttcagcacatagtattattcttaatgttagacgttctaatagatgtgtatcagtattttgttgtgattttaattttcatttcactaataactaatgatgttgagcatcttttcgtgtgcttaatggccatttgtgtatatttttggtaaagtgtcacttcaaatgttttgcccattttaaaatactgggttgtttatcttcttattattgagtcgtaagagtcttttatatattctagatacaagtcctttgccagatatatgtattgcaaacactttctcccagtgtatggcttgcctttttattttcttaacagacaaaaacttttaatctttatgaagatcaacttaacttttttttctttaacagctaagtgctttatttttcattttctatttttatatatttaggggcacaagtgcagatttcttacatgcatatattgcatagtggagtagtctgggcttttagtgtacccatcccccaaatagtgaacattgtacccaacagttaatttttcagccctcactccccgctcactctcccatactttgtagtctccaatgtcttattctgctctatatgtccatgcataccctttgtttagttcccacttagaagtgagaacatgtggtatttgacttccttttctgagttatttaatttatgataatggcctgtggttccatccatgttgctgcaaaaaaacatgatttcattttcttttcatggccgagcagtattccatggtgtatatatatataccacattttatttaccctgtcatccattgatggacacttaggttaatttcatatttttgctattgttagtgttgcaataaacatatgtgtgcaggtgtctttttgatataatgatttatcttactttgggtagacacccaatagtgagattgctgggttgaaagataggtctatttttatgttttgagaaatattccgttttccataaaggttgtcctactttatgttcccaccaatagtatataagcattcccttttctctgaatccttgccaacatttgttgtttttttgactttttttttaaattatagtttaagttctgggatacatgtacagaacgtgcaggtttgttacctaggtatacacgtgccatggtggtttgctgcacccatcaacctgtcatctgcattacgtatttcccctaatgctatccctcccctaatcccctaccccctgacaggccctggtgtgtgagtttcccctccctgtgtccatgtgttctcattgttcaattcccacttatgaatgagaacatgcagtgtttggttttctgttcctgtgttagtttgctgagaatgatggtgtccagcttcatccatgtccctgcaaagcacaagaactcattcttttttatggctgcatagtattccatggtgtagatgtgccacattttctttatccagtctgtcactgttggacatttgggttggtgggttggttccaagtctttgttattgttaacagtgctaaaataaacatacgtgtacatatgtctttatggtagaatgatttacaatcctttgggtgtatacccagtaatgggattgctgggtgaaatggtatttctggttctagatccttgaggaattgccacactgtcttccacaatggttgaactaatttacactcccaccaatggtgtaaaagcattcctatttctccacatcctctccagcatctgttgtttactgactttttttttttttttttttttgagacagagtcttgcactgtcacctaggctggagtgcaatgacacaatctcagctcactgcaatctccatctcctgggttctcatgactcttctgcttcagcctcctgagtggctgggaatataggcgcacaccactacacctggctaattttttgtattttcagtagagacggggtttcaccatgttggccagactggtcttgaactcctgacctcgagatccacccgcattggcctcccagagtgctgggattacaggcgtgagccaccatgcccagccgtttgctgactttttaatgatcgccattctaactagcaggagatggtatctcattgtagttttgatttgcatttctctaatgaccagtgatgatctttttttcatatgtttgttggccacataaatgtcttcttttgagaagtgtctgttcatatcctttgcccactttttgatggggatgtttgttttttacttgtaaatttaagttccttgtagattctggatattagccctttgtcagatggatagattgcaaaaattttctcccgttctgtaggttgcctattcactctgatgatagtttcttttgctgtgcagaagctctttattttaattagatcccatttgtcaattttgggttttgttgccattgcttttggtgttttaatcatgaagtctttgtccatgcctatgtcctgaatggtattgcctaggttctcttctagggtttttatgggtttaggttttacgtttaagtctttaatccatctatagttaatttttgtataaggtgtaaggaagtgtccagtttcagttttctgcctatggctagccaattttcccaacatttattaaataaggaatcctttcctcattgctttcgtcaggtttgtcaaagatcagatggttgtagatgtgtggcattatttctgaggcctatgttctattccattggtctatatatctgttttggtaccactaccatgctgttttggttactgtagccttgtagtatagtttgaaatcaagtagcgtgatgcctccagctttgttctttttgcttaggattgtcttggctatatgggctcttttctcgttccatatgaaatataaagtagtttttttttttcgtaattctgtgaagaaagtcaatggtagcttgatggggatagcattgaatctataaattacttagggtagtatggccattttcaagatattgattcttcctattcatgagcatggaatatttttccatttctttgtgtcctctcttatttccttgacaagtggcttgtagttctccttgaagaggtccttcacatcccttgtaagttgtattcctaggtattttattctctttgtagcaattgtgaatgggagttcactcaagatttggctctctgtttttctattattggtgtattggaatgctgtggtttttgcacattgattttgtatcctgagactttgctgaagttgctcatcagcttaaggagattttgggctgtgacgatggagttttctaaatataccatcatgtcctctgcaaacagagacaatttgacttcctctcttcgtatttgaatacccttcatttctttctcttgcctgattgccctggccagaacttccaatactatgttgaataggagtgaggagagagggtatccttgtcttgtgccagttttcaaagggaatgattccagcttggccattcaacatgatattggctgtgagtttgttataaatagctcttattattttgagatattttccatcaatacctagtttattgagagtttttagcatgaaggggtgttaaattttatcgaaggccttttctggatctattgagataatcatgtggttttcgtcattggttctgtttacgtgatggattatgtctattgatttgcatatgttgaaccagccttgcatcccagggatgaagccaacttgatagtgttggataagctttttgatgtgctgctggattcagtttgccagtattttattgaggattttcacatcaatgttcatcagggatattggcctgaaattttctttttttgttgtgtctctgccacgttttggtatcaggatgatgctggcctcataaaatgagttagggagaagtcgctgtttttctattgtttggagtagtttcagaaggaatggtaccatctcctctttgtacctctggtagaattcggctgtgaatccgtctggtcctgggttttttttggttggtaggctattaattactgcctcaatttcagaacttgttattggtctattcagggatttgagttcttcctggtttagtcttgggagggtgtatgtatccaggaacttatccatttcttctagattttctagtttttttttgtgtagaagtgtttatagtattctctaatggtagtttgtatttctgtgagatcagtggtgatatcccctttgtcattttatattgtgtctatttgattcttctctcttttcttattagtctggctagcagtctatctattttgttaatcttttcaaaaaaccagctcctgggttcattgattttttcgaaggttttttcgtgtctctatctccttcagttctgccctgatcttagtttttgaatttgttttctcttgcttctctaattcttttaattgtgatactagggtgttgattttagatcttttctgctttctcctgtgggcatttagtgctgtaaatttccctctaaacactgctttagctgtgtcccagagattctggtacgttatgtctttgttctcatttgtttcaaataacttatttatttctgccttaatttcgttatttatccagtagtctttcaggaacaggttgttcagtttccatgtagttgtgcgattttgagtgagtttttaaatcctgagttctaatttgattgcactgtggtctgagagactgtttgttatgatttccgttcttttgcatttgctgaggagtgttttacttctaattatgtggtcgattttagaataagtgctatgtagtgctgagaagagtgtatattctgttgatttggggtggagagttctgtagatgtctattaggtctgcttggtccagagccgagttcaagtcctgaacatccttgttaattttctgtttcattgatctgtctaatattgacagtggggtgataaagtctcccactactattgtgtgggagtctaagtctctttgtaggtctctaagaacttgctttatgagtctgggtgcttctgtattgggtgcatatatatttagggtagttagctctttttgttgtgttgatccctttaccattatgtaatgcccttcgtctttttttggtctttgttggtctatagaccgttttatcagagactaggattgcaacccctgctttttttgctttctgtttgcttggtaattatttctccatccctttattttgagcctatgtgtgtctttgcatgtgagatgagtcttctgaatacaacacactcattggtcttgactctttatccaatttgccagtccttgtcttttaattggttttaataataaccattctgactggtataatattgtatctcatggggttttaatgtgcatttctctgatgattagtaatggctagtggctagtgcttttttgtgtcctgtgtgttcttgcatattccaagatcatgacagttttccgctgcattttcctctggtagttttatagttttagcttttacatttaggcctataatacattttgagacaattttttatctggcatgaggtaagagttgaagttcaatttttccttatggttattcagttatgttagcaacatttattaaaatattatctttttctcattgaattttacctttgaattttattcaaaaaccatttaaccatatacaggtggatatatttttggactccctattttgttccattagactatgtgtagtatatgctgatactacatatcatgattctttttcaaaatcatttaggcttttctaggtcctttgcattgtcatgtaaaaaattggctcgtcaatttctaccacaagagcctggggagattttgactgggtttgcttagaattcatatcattttgaggaaaactggtatcttaacaagttgagccttccaatttataaacgggatatcactccgtttatttagatctttaatttttctcaatgatattttctgctttctagtgtacaggtcatgttcttttgttaaatttatgcctatatataataacaaatttttaaaaattaaatatcaagagagaagagacagtgaaacttatccaggagtgcagcctgttttcgtaaaattaatttgtgattgacaccaacaagccttctgatctgaaatttcaagtgttctggtgagtaattggaatttgtgtatatctttttttctaagctttttatatcaatgtcttttaaggaagcaggcatatattctcctcaatgagaatctccaaatgagccttttactttcccctaaggtttggcttccttatgtttgactattgccttatacatgttatttgttatacatattatacatgttgtttgttcattgacttattggcataaaggccataaaaatactttttcctccttcagaagtctcttccacattaatagctttatctagtagctcagttatggaaactcacaagcctacatctcgagcccaatatttatcaaaactctagttgtaaatcatctattttttgctgggtgtttccatatgtaaaggtttgttaatttaagcatatctgaaaccaaacacctctcccctcactcacacacacacacacacacacacacacacacacacacaatttcattaaacaaacacattgctactatctggtacaaatagatgagtttaaatcctaatgtaaaagacataaatggaaacaaagtttcattgcataatctgaaaaattgcataataggggtaaagaaagattattatggaagcatctaactgttactggtgggttcaggcacttcacaaagaaggtgatgcctaaactgggacccctcaaatccatttttgttcatcaggttgaataaatcataaaataattttgtcattcataatgttagtccactccatgtttgaaaaattgtagttattctcgattcttttctttctcttgcacctcaaattcagtcagtgaatactatcagttttatgcattgtagcacggtcattaaatgtgttgactctaaaactattcccactgtatttgaaacctgatcccagtccttacttgttgtgtattttggcaagttattcttcctctctgtgcatcagtttatttttctgtaaaatgcagttaataattatacctacctttgaatgttaatataaggataaagtaagatagtaaatattaattctttacctcagtgcttagcccatagtgaagtattcaataaatattcacagttatcaataatattgttatggcatcacttaaatattttctttcctttccaacacccttgaaataaccctggtcactcttttatttatttatttatttattttaatagaaacgaggtctcactgtgtcactgtgttgggcaggctggtcttgaactcctggactcaagcagttcttctgtctcatcctaacaaagttctgggattacaggcataagccaccatgcccagctccccaatcactctttacccttgctactgtagtactgaatccatattcaaaaagttcatatgtatgttgattgtttaggtgcaccgcttgcattttctcatagaaacagtgttgtgaatgatggttaaattaacaggccagtccagcaaaaactaatttaatgcaaatctgttaaatatattatcatgttgagtcctctataacctagctattgcataataagtgtttttcgattattcaacaaatatttagggagtacctaccatgtgcccagaactatttggtgcttagaatataccagtgaacaaaacaaagattctgagcttgaagagctaatgttctaaaggtagaagttaggacttctttacaatcttacagccttctgccactactttctaaacttaaagcagacacacagctttttggaagacttctaaggcatttccatggtaggattctaagaaagacaacaaatgtttaaagaggctcccttccatactttcttattctcttggttaattttgtctctggagaaacaaattggcacataaaaattagcactggatctttggctattcaaaatgaagttttagcttcatttgagaggagaaacaattttaagctacagaaaggcatttttttctgcagaaattggatgggacttatgctgtcagtgaggacccagaaggaaaaaaaaaaatgggataggggaaacagcagctaggacagtgctggtgagagcatcttctagggctttattcactattcccttttccctcaccacttcagccttgccatttcagactctccagtggaatagcctgaatgaaaagacaagaagagaaaaatacccataagcatgggaatgagattttaagcttttgggatggaaagggaagggaaggaaatcacagaaactggctctagtaaaggatgtcagtttctgtcctcaaatgcctccagggtatataaataagtcagaaatacccaacttagattttgacagcaaacagacctgggtttgaatcctagctcatacatttatgacctttttacgtttggcaagttatttaaccactctaattctttgctttctcaattcagagttaatgagagggagcaccttatggatatgattcttgctaggattgaatgagataatgtacataaagtgcttataagagtgactggtacatagaaagtgcccatccatgaaaattagttcttttcttctgtcccataagaattaatttcattgtttcataaacatcaatgcatcctttccttccccagtccaaactatcctagatactacagcttagaaatcgcttaaaacaccttttggatctgctatgccctgccaaacaatctccaatggatccccatcacctatggggtaaagtttaaacttaggctagtattcagagtcctccacaatctgagcccgactatttcctctcggcaatcctacatgaacattttactcaagcccgatttgtcgacactagtgtttctctaacagaactcagggcttgttgtttaaggatagagccttgattttgccgggaggctagtggtatgatggtgggggtgctgatagcatttcaaacaggggagggcaggatcagagaaaaaccatgtttctcttttctctctctccctctgtcccatgaagtatgcctagattgtcttagccagaaagtgtttctttaaaagaccaattactgttcctgcgtgtttgggggagtggggagggcgatgggaaggagagcatcaggaagaacagctaatgggtgctgggcttaatacctggatgatgggttgatctgtgcagcaaagcaccatggcacacgtttacctatataacaaacctgcacatcctgcacacgtacccccgaacttaaaataaaagttgattaaaaaaagaccaattactgagtcccagttctataagtcatggtgctaagaatgggcactacagtgcttcctccttgattatgtaatcacaaagaggagaaagacaaatgtttttatctaattgtaatatgatatgattcttccaggtgtatgtgtatgtgcgcatgcatacgtctgtgtgtgtaagtgtgtgcgtcatgtagacacatgaagggaagtgtgacaaattgatgtaagtaatcatttactaagatggtaacatttgaatgggaacttgagatatttgacattccagaaacaacaagcacaccaagtaatggaaagaaagggaggacatttgagacaggggagcagaagatgcaaatgaatagaggtgtgaaagagtttggtgtgttcagggagtcccacaaagtctaatgagactttagtacagtcttgggataagaagggagttgaaaataatgataaatggagctctgaaggtaggttggagccaatttagggattaaattacaatgataattgtaattatcatttattgaacacctagtatgctctaggcactgcgtaaaatgctacatatatgtgtatatatatacacatctgtgtatatatatatatacacgtgtgtgtgtgtatatatatatataatcatttttaaagcccttttttttgagacagagtctcactttgtcactcaggctggagtgcagtggcacgatcttggctcactgcaacctctgcctcctggggtcaagcaactcttgtgcctcagccaggtacgaccatgcccagcgaatttttgtatttttagtagagacggggtttcaccatgttggccaggctggtctcgaactcctgacctcaggtgatctgcccacctctgcctcccaaagtgctggcattataggcatgagccactgttccaggctaaaaagctttttatcaatcatatgagctataagaaatattattatccctatttaataagtgaggaaactgaggcaaagattaaataagtgttcaaaatcaccagctggaaatggtagagccaaggcataaacctaggtctataggaccgcagagtcaatgaacatgaatgaatgaggcattgccaatggtgaggtgaaaatagagcagagagattagactctgaggcatcctctgagatagaaagatagtgttaatgtggcctggtaacttgtttggtgttgaaggctagagtagaggcatggagtatggagggtgactctaaggtttctaatttgcgagatgtcataatctcattagcagagatggaaaatttaggaggggaagagtggtagtgggagcattaatacatttggatttgtatgttttataaacttcaatatctgaaatggactgaaggtagtcactagacttataaatacaagtcgaaaggtctggacagaatatagagacctgggaccacagcatttgggcaatagtaggaggtgtgattatggataaaattacccagggggaatgtataaagttagaagagcatcagggatggagtacttctttctctgaaacattttacattctccttgtgaaatagcataagcttcctagtgttatgtagttttttttaaacctctctgatctctatcaaattatcagctacttgaggacagagacctccttgatgaatttctacaaactagccaacatttagcaaagagccttgtgcatagtgtgaattctttttattggattgtcccttagcatgggggtgttagggatgggactctgaagtacctgtgagaggctttgggttgtcagctaggagctggggtgagagctatacattgggagcaatggaggtgagaagaaggtgcctaccactcagaggttgggctgttttccccatttaaatgtggcaatatagttatgtcaaaaagtataaatgttgtgttttatcaagtaaatattcttaggcttgctgttggataaaatttggtggagtcagggggaaatccttcaacttatgctttaaatttctgaaggaaacttccaaatgtagtaaaataacaatctgagcttgtattcatttttaaatttaggaaaaatatttcaatcatgcattacaatatagctgtttaaatgaactatgattctttcagcatttgtgaaataaataaaacagggcactgaataaaaccggagtattgttatttcactgttgctaaaagacaaaatcaatacttgattactctgaattagtatatccaaccacgcaaatctttaacctcagattaactaaacataagaccgtgacccaacctacaacagtaacatttagcaatagagaatgaactggtgctgagcctgtttgtaaagcttggagttgcactgatgtccaggctagttttctgactatcattctgtctgaagtagctgcagaattatgtcagcagaattttaactaactggcatttctgtgaccgtttcctttctcctactcctactactcattttataacacagcttataaatgaggcctttcctcagggaaatgaaaggcctcagtgatactttgtatcacattaaaggttgttttctttgttaatattgcaaagagttttacaaatggccatttctcatatccctaactgttcattaaatcattcaaaatttaggctgggcgcagtggctcacgcctatgatcccagcactttgggaggctgaggtgggtggatcacgaggtcaggagatggagaccatcctggctaacacggtgaaacgctgtctctactaaaaatacaaaaaattagccgggcgtggtggcgggcgcccgtagtcccagctacttgggaggctgaggtaagagaatggtgtgaacccgggaggcacagcttgcagtgagctgagatcacgccactgcactctagcctgggcggcagagcgagactccatctcaaaaaaaaaaaaaaaagttattcaaaatttaaaacttacgtattgattacctgctatgtgtcagatagtatactaaacattggagctataagtagtctgcaaaactggcaaggaacctatacatacattctatactggtggagacagataatatacaaacaaatacgtaagtgaactaaataatttcaaatagtgattcataccagacaataaaataagataatgggaaacagtgattttgtggtggtggtagtggagagctgggaaacattaactaagattattaaaaagccctctctgaggaggtaacatttgagctgaaacctgagtgatgagaaggactcatttaggcaaggatgtgggagaagaggatcccagacagaagtaacagcaggtacaaagttttgaagcctggaatgagtgggcgggtctatggaacagaaagaaagccattgtgaatgaagcaggtgtgagtacatgatttgaaaatggagaagcagtcagagttcagatcattcagggtgtcatggaccatgataggaagcttaaatttgattccaaggaaagtgggaagtccctgttgggtttatcactctggcttctgagatttgcctcagggccttcttgtttcctggcatcctgcttcttcctgtagcaaatcctgcctgggtttcactagcctggagaagtgattagctccccagtgatctagaaccatcctttctgtgctgtcactgtccttccctgacttcacctctccctgcctgggatctgagggagacttccttatttctgtcaacagaggggcctttccagaatttgtggatcaggtcagaaaaagattccatccttgaaaggccacaaaaatcttcctggtgtagatgagtgcaatttttttgcagcagcacccctcaggcagatgtatgaaagtgtagctgcccaggtgagaacatgtacccaggaaggcctccatctcagaggaaattcatgggacatctctgcagtgtcattgatttcaacatactcttcacgagatgtcaggatgatggaagctgttggtgtttaataagaaattttgaaaaaaagtgagctagatagaaatctgagatttctgcatgccttcagcttggtccaaggctttgcgtccttagaaaggcagtctctgtggtttgggattccaccagagtggagtaaaaatgcctatggaactctgtagttacagattttgtgtgtatcaagctgcctttctattgtcaaaaataaccttttcggtttgtaccgtgctttccagttcacaaaccttgtcacatgcacaatctaattttatcatcaaaccaaacctacaaggtttaattctatgttaaaaattatgaaactgaggaccatagaaaatgaccccaggaaaatgtcaatctttacataaactatagagaaatgaatgaatgtggcaaatcctttaaaaatagagctaatgggatatttttatagttagttatggaagatgcataatacagcatctttgtcattgccatggacagaaaaattgaattagggctagtctatagaagttgttattgtagaacgaagttattaattctccaagtagtttgttatgtttaagtttcatacagctaaaataaatttttttagaaaggcatttccttttctttctatttttttttctttctagttgtttcatccttggtgtagctctggattaagtaatcaaattgtgaatattctgtatgctgatattaagtacattgtttaataatgtagttttatgttaaaaaaaaaggctcttccctttagtgggtcatgagatatggacaggggtgaagagagctggacctttgaaatgagagaagctcttattaataaagagtagattccagttatacagtgacagatgggacccaaggacgtccagaagtttgtgaaggacattgtcaatgtcataattgcaggaatacatctcagtttccctaggcttttgtaatcagtggtgtgctacatgtaaatcacatctatttcacagagttgttggtcttgaggaagagtttgggaagtaactgtgaaagaggaattgaactcatatttacagacctcctacaatgtgcttggaactgtggcaagatttttctgagtgttatcccatttactttccacaaaagtattgagaggaagtactaagctctttttggagatgagaggatgtcactgacccttaaagtggttaagtaccttgatcaagggacaaagctggcagattaaagattcagacccaggtgactccaaagcctactttttctttcctttacagcccttgtggtgacatgaatgaactttcttaattaagattgctgattcgtttatattttctaacgtgcatcataacctagctgtttactgtagttaagtcttttattttttttttcttatggagtttcgctgtcgcccaggctgaagtggtgcagtgatgcaatctcagttcactgcaacctccgccttccgggttcaagtgattctcctgcctcactcagcctcttgagtagctgggactacaggtgagtgccaccatgcctggctaatctttgtatttttagtaaagatgggttttcaccatattggtcaggctgatcttgagctcctgacctcaagtgacctgtccgcttcagcctcccaaagtgctgggattaccggcgtgagccatggcgcccggcctagtcttaattttatattaagcaagcaggattaacttccctaattctggaagtcagacggttgagttgtagaaagatgctttatgaatctttatatgaatcttccttctgctgttaggtttagtagagcaacccccttaatatcactatttctggcgctttgattagttgcttgttggaattgtcaaaatatctaaaaattttaataaaatagaaccttaaagggagaaaaatcacaccgtgagcccaagagaactccaaacactcaccaacatggggaccaaggcacctgattattatgtattgaggtaccattaagacctgcagtattagtttcaaatgaaaacaaaatgagacaagatatgtgcacagcttttatgacaaatttataatattgaagacaaattaatttaggtaccattttacagtatttgtgccagaaagaaaattacgagagctgggagaacctaggaaaagccaataagaactgaaaagggaaattttcatgattgggtttttaaaaattagaaatataagttcaacacatacacccaccttttgccttatagttgtaaacatttttgactacaaaggaaaatatatttgcaatgtcaagtttgctacctcagtgagaataacttattgagattcaaatgtgggatcccaaagtaattttagatttgaatgattttcatcgtggatactttttagtttgcttcttgcacttcagcagaattttcctcacaattttggcttaagtttccatctccaggacataatcttgcaggatcacctctcacccttatctcttggtgactgggtactgagatgggacattatgaacttgatctgacaatttaataagatgtaataagacctgaaatagaggcaatgccctttcaactgagaagatctagataggtacagaaacttttcaagggtatgtctaactaaattcccgttaagaattctctttgaaacattaaatgtcttttcctgtttgaaactagaatgtgatcagttggaatattggcaaagaacaggtcattagtgaaaactccaatgaagacaattggctttgggtttgattttcctgtttttgcagttagcttagcaccagatggtgccctagtgagttctgtataaataatacaatcatagggttgagtgattttctaccagtcacagactgaagcagaaaatagcacttgtctttccacacaagctcatgtagattcttttactgctgaattgttcttatgcagctctaacccttaaattgttattatggttgggtttttttctgtttctttattgggcaggcaagcagccaaatcctcactctgacctagagggaagggctgctggatttgaggatctttagctgatacatacatcccttgcagaaagaagaggcaaagaagtaaaactccctgaattctctctattgttcctggaaaaaaaaaaaaaaaaggagtggccctacacattcccttgacagttggtgaacattagggggtgatggaactggctttgcttacagaaattctgtgacaacctcttacaggctttcaaggttcacctcaagagccaactccagcccacaatgctcaatgatctctctctgggttcatatgacagttgtattttgtacctcaagatcaagctcttcattgcactgtatggtgttataccttccccactcttttttctttggatgtaagtcttgtcttacctacaacattgtaagttgctctgatctatttgcttacaacctgcactgcttaacacagaattgggtatttaataactatttgttggcatatgtgggtcacagttctcaaacatttgagcagagttttaatggtcagtatcctactgaaagaacagagttcatatattgtgacataaaagattctagtttcttgaaaaagaaaaaataaaaagcctttgctgctcttccctttctctttactctcccgaagatttgacccatgtagtagcgaaccacagaaaacatgatgtagcatatcgggagcaatgggcagaatcactaagaatctttcttcttttgagaagagcctctgtttttactttggaagcacaagtactcatacaatatgtccaaccttcactaaaattggcccactccattgtctttctaagcaaacatggggctccatttccaagtgactgttatttcctatgtgttagatgtttggggtgacctcaaaaaagtcattagtgtattcagaacaagttattcaaactggtaatttattaatcatatccaaatgacccatttcacatattccccaaagtattttatggtcttctgcagggttcccaaagtgtttcctgtggaatatcagtattccatgagatatgaatagatgcctcttggaaaaaaaaattggttgttttgttgtttggagaaatgttagactctctgtttgcctcttggggcaacacactgcatgttaaaggctctgaggattcctgcagcaaaaatatctggttaatttgtttaacttggcatttagcaaacatatttgaccttagaaagagaatatctagtgagtattctgtgccaggcgtacattaacttattgaatctctatgctaagactctaaattaggtaccattacctggatttaaagatgagggattgagaatctgctatatttaaggactttttctaggtcatacagtgacagagtcttgtatagtgagttcttatgttgcctctgccaccagctagctatgtgctaccattttgggccaacaggtcaatcttaatttccttatctgtgagtcacagttaaacaataaggttgctttgaagatgaaacttagttgaatttatattatagtattttggttaaaaaagtggtgtataagtagcatttctactttacaaaatcaggaggagaaggaggggaaaaacatcatcctataagaaacaacatattcactcaacatattcactcaaaacacataatgctaactgctagacttttaagaacgaaagcaagcaaacaaaaacgtagttttagctgtgcagaatagtgaccagaacatgtacattttcatttataagtattatatatttttggtatagtcagactctgcatctcatgtaccgatcaaattgggtagtacaacattaaggcacccaatggtattgtgaaattttaagactagaaatacattatgactagatattggagctttgatccttaactacaactttccttgcttctatggctttaagccagaagctgagcttctttgatttttcttttgtatcgtccattttaggtagacactacataaaccacttgtggctctgcctcactccaccaattccacaatgtggtatctgattgttaggactccactgtctctcccaacttgtcaaattcaccatatgaggtaaattcatttctacttggcactttacaatcttaatgtttaatgatgtagataataaatttccccctaatttttgattattctgcttgtgaaatctagatatacatacacatacatacatacacacataacacaatagagattctgcacatcagcttgaatgtggagatgggtttataacaaaggggaagaggacttctaattaaatgtctaccttgccaaattggaaactgatttccttgttacccaagttgaactgaatcctgttttcaatctagaagtaattaccaaggcagtacacaattgtactgaggcagactgcattttgcattctgcatccctgaactgtcattagctgatatcataaatattgatatatagtataatactccaccaagtttattaaaaggataatttagaagtccatagtggttttatcatccagggttctgccattctcagaagtgtgatgagtgtttccgtggttttcctagattttgtatttatgagttgtttatggctctgacattattttatgtcagaattcattaacctttaaaaagtttctgatatggtaaggccttattgtcacctctgctttctagacacacagaatgcatcccaagaagaggagatggaaccgatagcattcagtttactggaagctgctttctttggccacttggtttctgaggtgtagtgctggatgtgctgtagagggcagaactgcctgtgatgtgatgacattccatttcctttattgcagccccaaattacaaggtccattctctgataactatgatttcttgaaaggtgtgcatccatctctttactgtaaagaatagaagagaaatagtgccactgtttaaagaatggtttcatacgtaagaaaggataattgccacggaatctgtgcatagcctgaaagagtttatactctgacaaaagcatttctttaatggcaactccctgggtggattaatgcttctgtctgggttcttctcaacagagcttaaggggctgaatgggatagacaatacaaaaaaacccaaacagacaaactagcaaaaacctcccccattccttttaaaaccttttgctcttgtgcagctgaaaaagtgaagcaactattagaaatacctcttaacacttattaaatactgagccttctactgctaagcagtgacttaggaagtaatgaagctgaagctagacctactttaatattgattctggcctgaaataaacgtttatgtccttgaaataatttgttggtggttgtttattcattattttctttatatattaaatgggaagtcctttggtctccttcaagttctggatgggctaattagccattttgtaaaccaatatagtaccgtatttcgtctggataaattaatttatagtcttacattgaaatgtaattaaaatgttgttgcaactagtttttagtccctaatcagcagttgctgttaccctgtacacgaattggatggtaaattttattagccctttttcctgggcaaaagatagtgtctaatcacagtctgatccacagagctgcagaacaagcccgcaacttaagcttgctaagcaaaagttttccatgccccattattaaagatatagggagaaagatgtttttctttttgctttgatattatgttttgcattttcttgttgttgtctttatgcttgacagttcctaccttatgaacttgaaaagaaataacgccattttttgttggaatttaagccaatattcacttattttgttcttccaatataaatgccaactacaaacgcaatcaatccatcagtttgtctgacaatgctatttaaaagtaaatttcagcattgaagcttcattcattaatttattctcccactcaacaaatatttatgtatgctgaccctgttcaaggtattgtgctaaatagatcctatggagttttttgaggacatagcaaaacacgacccttttatttatttatttatttttgagatggagtcttgctctgtcgcccaggctggagtgcagtagcactatctcagctcactgcaagctccgcctcccaggttcacaccattctcctgcctcagcctcctgagtagctgggagtacaggcgcccaccaccatgcccggctaatttttttgtatttttagtagagacagggtttcaccgtgttagccaggatggtctcgatctcctgacctcgtgatctgcctgcctccgcctcccaaagtgctgggattacaggcgtgagccaccgcgcccggccgacactttcttaagtttaaaatttgacgttagtcaagttaaaattttaacataccagatttttagccaaaggaggccaagttgatgacagaaggtatatcagtaggcgtagtgtattgtcacaactatagtagtaacaatgtgaagacagcaacaatatttgctgaattagtgacttaactggaaatttaaattgcttgactctcagccctttaaaataacacggacagagttttttgtaacgatctgtgcaatcatgtaactcacattgctaagcatgttttcttcagaaggcacattatctcaggatcaaaataaggaatattgtatcatatttgtgtcacagacctcaattttaacacatttagtaaattaaatggaaggaactaaaaatcagtggggctttgatttgtgagaaatgtatttagaatttttggtaacagctgtttgcaccttaggtgagatgtactaaaatgctttgtgttgctttacaacattgcttgaatttgcagaaataaaattttgtgactatttctgcatgtacatacatactcacatacacacatgcacctcagttgaaaaaaagattggtgctactcagaatcgatagagacaatatagttaatgaatctatgtctaattcaaagtgtatcttgctgattagttaggggataggccaacaaaattctttgcgctgtgaactaatgtatattatcctgaaaggggttaaaaaaaaaggagcagaaaacaacttcttttcacctaaacttgttctcaggcgagaggtcacaaccatcactcagtaccagaaacctggtcttcagtagttagggtcaaatgggtagccaaccttctaacatgagggtagggtggtggtggttggtgagtctggaagctgaacagccctggaggacaaggctgcactgttacatggcagctcagcacacacaacagagttccactctttatcttctttgtgttaacaggctcttgtttacacattgctatttctgacaccttttcaacaaaagattaaggtagttgaaaaatcagcccttttgaagcatgcactcattggaggaaaagttttttttttttttaaatcattactctgctactagtatttctctagagtttctctcatcagaaactctggtccaggtgtcatggggaattaggattgtttgttaggtctggataaccaagtattacagacttcgagggtaggaggaaaccttatggtcatttagaccaacactcatctgatgtttggatctcttctgtttttaaaaagagtcccacttacagagaactgcctcctgagacagcccttgttcagtgttttctcaagagtgttctctttaacaccagcctcaagaggtactacaaaaagaagtgttccatgttcaaataactttgagaagcaatagtcaccatatcgactttgagtattcctgtagaaaataaacctgtttatatcaacttggagtatcccccaacttatttggtcatggaaactctttctccaagaaaacatgctttagtatttcattccacagaaaactcactgtagtatgtgtttttttccagataatacatatttattaaagcaaattaaaattgcattggctttttggattcatataaaactgacctttgacttcttgagtcttattttttagcacaacttgctgtttagccacatcagcatgttttgtttggcttgactttttggtcttaagtattggtcttcgtttttacattttgtcttgttggaaccaccctacctctccagcttggctttttggatccaggctaagtcatcttgtacattcttcagcagtctgagatctgtactattcactgatgtcataagcatactctcttcatctttattcattttgttgattggaaatgatgagcaggactggacaaggttggtatcactctataaaccatcacccattgattctgactgttaatctcccaaattagtaaaaaatttttcagaagagagtttccaataatccatgcctctagcctttgtggtttgcaaacctttttttcaagagccaaatcatgtttccctatttttagctctccaatttttttctgaggagaaactggtaataatatggtttctaaatatagtggctcatcagctcttcataaaaccaatgccatctcttttgaagaagtaatgttggtcaaaatcctgcctcatattttgcagaatatgtttttggaatatcttaaaacatccatggtgtctttctgtgcatagataatttagtttgtatggtttcggtatatttgcgtttgtattgtaattttctgtctgaaggaatagtttcttgaagttgtatacgctaattagtatagtttgtaaaataatagatacttttaaatgtgtgggaggcacagctttcaaatgaagtatttaaatataattgctgtttaaacgtttaacttaaaagatgtgtattaattaatttttctataactaactgcaggtttagggtggcttattgttaattaatctctgcacaaagcaaaaaaaaatccaatctgttgcccaaacttacctgagacatcctattttaaatgtactttatttatatttatgcaagtatgtttgcaaaggtttagccccaactacttattaacactaaattggatcctggagaagatttttttgctttgtttgcaaatccctagtgtagtattactgagattttgaatctacttttcaatatcagagcatctttaaatgttcattgttaaggtcaacttacaaaggagtgtgtcagaagcactagagagctcaagttctgagactgaaaagacctgagttcatgattgacaccatgccattttctagctgagtcactttgaataagttattttatgtgtctaaatatcagttcctcatttgtaagatgaaaaaaggatgatgatggatacctacctcataggattgctttaaagattacatgaagtgtattcaagtgaagcacttatcacattgccttacacacattaaaaactggataagtgattcttaagctcttaagttttatctataagaaaaacccttaaaatgtccacgaaaagttggcatgttaaaaatgagactttaatttgcacaaggttctgacaatcaaaataatcatatttctcagaagtcttctattttcatgatgatgatggattatatcacctgacttatacaacacggtagcatatttgaaattcagaccatttcagaaaatctgtttcacacagtcaccacatcaatagaacccaaaacatatctcaatcataacaccacattgggctgaaatgcatcttgtaagtaggacaagtagggtaataggatctactgctcttgctaggccaagatgtggtccagacagtcagtcagaaaacaaacaaataaaaacaaaataatggtcccttcccattggatacttaactcgcctgaatttgtcaaagtggcagtgggcttctttaagataatttatgtttaggacatggctctggacattttgtttccctatcaaaggcagctaatttgattaaaattttgtctggatatttttcatttcttaggtacagcctaagttacagaaatacatgtaccatggctctgagtgaaatatctttgggtggagtagacccctatttaatattaaaagtatgatgagatttaattatcaccagtcctgtaaggattcagaggatgagaccagccaacagcccaagtcctctgaagagacagcctcagagaacaaattcaatagatgatatcagacagtcagcagggcctcagggacgctggtacaaattactttctgcacaaggaggccctgctgagggggacgtgaatttgaactgtaacatagcctgcattcaactcacagtgggccctttatagttgttcagcctgaaggtggcaccttgtggtaattcttccacgcagaggaagagtcttattgtattttaaacaaaggtgcttcacaatgagtgcagacctggcaatcagtttccattcagactttggctctgctcccatgtgtcttataactgtatatgaagggacaagaccctttaatagagaatttgccctgttttaggagctaaatgacttggtccctcccagaacaatgcttttctttctataatatttcttgaaatgataatttagtaaggtaaatgataccttaacagtacaataaaaaaagaactgggactttgtagtcagaaagccataaagccctggattttctttctaatttcagtatctccaggctttgtgaccttgatcaagttaatggaaaatggggcatgtataaataaatcagattgactctctataacattttaaatggtcatatatacgctgtaaatgttattaaatttcaatgaaatttggtacatgagtagaaagaaatgaatgatttatgagacaaagaaatgactctctttgctattttaaagcagaatcatcatcctatctataatatttaccttaggtgaaaatcacctctggtgcacgttgactgatagaatatatgtatgatactttacatttatgtgaattcaggaattcagagaaccatttcttatataatggctgcctctgggacttagaggaagtgactctttgtgctgtaatctggccctttggggtttgagctgcagagaggagaggacccatgccgctatgttttgaatattttgagatttgagagcagcaaaccagatcacagaaatcagctggtgctaggtccactgagctaatcttacaaacatttcagaaattgacaggtggcctacaataatcctattctgctaataaagtttttttctttaatttctctagtagaattagttctgtagagaagtgcccattccatacagaatacacttatcagcaataatattacaaggttgttattcacacaggaatgggaaaagcaactggaagttctagtagctttgttgctacattaatagattctgctgtcaggcataagttgttctgcaggaatactaaaaagtaacctaagaataaatagctacaaaatcaagttccaataatatccttataattattactagctccaggattgtggagaaaagcctactggaaaacgcttaccattcatcgaaatatttttagtaaacaacactgaatcataaagaatgttctgtgtgttggttgctaattgtttttataaattgatctgtgattcacttacttaattctgttccatatctgttccttattattttctggtaggagttggttcagaacccatattaatttatgatttctctggttcacaaattcctactttactcacattagaccatagaattaagctccatccccaaattgttttttctatcatctacattttttgatatcacatctactgttgcattttacttccctaaaatgcattgtttttcatatgactccttttaatgtgtctttgattttttaaattgttgtttccattggtgacatttttgagagtaatgttaaattagttctacaacttcttttggctgctataaagtctacaaaactggaagtgtaaagtagtatcagaaagaatgataatcttataatgcataaaatacttaatcaagtttaacagaacctttcccaatcctttttttgattgaatagcttacttctgttgggatccttagattgacaagctgattaggaaggaaatgtgtttggtagattctttgagttgtcacattctagacagtttcattttgatgtgtgctttaattaaaataaatttatatacaagggtgcggcataattttagcagttggtagagatttttggaagcttcttttttctattttcctaagggtatttttctattcaaaacatcgcattggcagatagtggtgtgaatttatcccaagctttatgaaaccaatcttttttttttttttttttttttttttgagacagagtttcactctcgttgcccaggctggagtgcaatggcgtgatctcggctcactgcaacctccacctcctgggttcaaacgattctcctgcctcagcctcccaagtagctgggattacaggcatgcaccaccacgcctggctaattttgtatttttagtagagacggggtttcactatgttggccaggatggtctctatctcttgacctcatgatccacccacctcggcctcccaaagtgctgggattacaggtgtgagccaccatgcccggcctctcctaggtttatgtgttgggttacctagctgataaattgggatcttataaacttatattgtgaatgcacactgggctagtccccttacctgtgaaatggctttcttggttttatgtctacctgagggcaggtgttttgccatctgttcttatacccccatgaatcagctctctggactccctggtggtatttgcttaacacactcaacctacctggtttcctgttagttggctatgctgcaatttgaggtgtccaaatgtagtggaaccctcagcatttcttttaaaagacagtctttttattcctccacagtcagctttgtttctcattccacccaatagccatctccagctgtgtcttcttccttcaaattagatgattaggttctccaaatctcatcatgaaaatggaagtcatcaagcatgaactccctcaactttgctcatcctcgtctttaaaatgttatcaagcttttttttttctcttttcctcctgtctttgagtaacaggcgtgttttaccaatatgttttcatcttttttttctttctactttcttgttgcaggtcccttaactcaggctgtcatcatctgtcattttctaactatgattgtctctagtcttctccactaacttgccagtccatgctccacaacatagcaaaaatgattcaccactcaaatcatgttactgagttgctttcaactcttctttgcctgcaaattaaaatctaaaatatgtaacatagcgaacaaagtccttcctaatctgaagtgttataatgtaattttcccccattccccttgatgcagtcatagtcactgttttctggtcataccatgcacatttatatcctggtcccttggtctatgcaagtatttgtgttccctttcctaaaatatcttacccaccttctggacagggtgagtttctactcatcctgcaagacttacttgaaatattgcctccatatgacaccttttccagtccacccctaggcagcattaagtcctacatattttcatggctgtgtttgcatgctttctttttgagacagagtcttgctctgtcacccagcctggagtgcaagggtgcaatcatggctcactgcagcctctaactcctgggctcaagtgatcctcccacctcagcctcctaaatagctgtgtctacaggagtgtaccaccatgtctggctatttttttttttttttgtatattttgtagagccagggttttggcatgtttcccagactggtctcgaactcctggcctcaagcgatgcacgtgtctcagcctcccaaagtgctgcgattatgggcgtgagccaccgtatctggcctttgcatacttttattacagcatctccacattgccttgcaattatctgtttgtgtgcctttctgtccttaatagcctggtgaacatcatgccttagtcatctttgtttctcaagcttctagcatagtgcctgacatacagtggaaagtccctacatattattgaatgagcaaatggaagaatgacaagtaagcagctcgggtttcatttgaagcctccaattccagacacttgaaagaataaacaacattacaagaaaactggtgaaattaaagcaagagatggcatagataatgacaggtaattactggattgcaaaagtcacacactagctgaggcttttgtgtaatgtggggagtaggaggggcagggatacaaagagaaatagagtgagatagaatgagtagctgacaatgatggaacacttgacacacacagacaaacatacacagacccctaaattttctatctggcacctccttttatcctcttaagcatgaatataataagccagtagcttacatcttccccagaagtgccttcccaaagggccatgttcaccacttgactatgctcctaaatgtcattccctatgcttctccatggctgaaaccccacaaggaggttgattcaacttactcccttccccaactactgccattcttagtctcctcccacttggtattacagtatgccaaatatttttcttgagttctgtctcaaaaggctctaaatagatccagccaccaactaagagacatgacatgtttaaattatatgagcctttaaactaaatgtgttgaaaggctgccccatttattcatttatccacacattcaacaattagattatgagtacctactgtgtgccaaaccatacagtactgagaaatatgtttactatacccttaggggatgatatcttctcatatatcaactacaatgaggcattccttctgcttttcaattttaagcagttttttggaatttagttgaataaagctaggtgtccccaataaatagtcttaaacccagcaatcttaaaatgatctggctgtagataatgctaggaatttttaacaaaattgggtcttacaaaataattggttttaccaatgaatttgggaaaactataacagaggtatctttaaccgtaaaaatgaccccgaaaatttatcaacctctctgcagacctttataagagaccagcaccccagttgatctttttgaggtcctttgagctataagatcctatggctagaatttatgcttgatattgaagtttctgagacaaacctctatgcggctttatgatccctctttttggcatcccatttaggaaaatgaactaaagtaagtggtctttggggtaatttggaatacagtgagtcctttttacgtcactggtgatggggaacactaagattttatagtgtataggtatttttgaagctatgatttgactcaatatattttatttcctactgtcatgagttatgacatcgacttttcaaaatttgtataaatttaaggggaacacgtgcaatttttgttatggatatatcgcatagtagtgaagtctgggatttcagtgtaatcatcacccaaataccgtacattgtatctcacattgacttttagataaagtggatttgatgttcagaaaggcttatctgtttttgtctgtatactcattttgctccaacaggtcaatttccccccctttcttcactataactccttaatttttctcacctttttgttacttctttaaaaaaaattttaaaaaaattaataagctttatttgtaaatcaattttagattttcaaaaaattaagcagatggtacagagattaaccatcctccattccatggagtttcccctattattaacatcttgcattattttgatatatttgtcacaatgaaccacactcatacattattattacctaaagtccctgatttattcagatttccttagtttttacctactgtccattttctgttgcaggatcccatccaggataccacattacagttagttgttacgtatccttaggctattcttggctctgacattttctcagactttccttgtttttgatgactttggcagtactgattaggtgttttatgaaatatccctctgttggaatttgtcttgtttttcctatgattagattggggtttggatttttgaggggaagatcatagaagcatataaaatgccatttaattcaaatcaaatcaagggtaaatgttatcaacatgacctatcactgataatgctggccttagatcacctggtagagggaatgtttgtaagatttctccattgtaaagttactcctcccacccacctttctatactgtagtctttggaaggaagtcattatgtgcagcctatatacttaatgagaagggatattccacatccttgagggcacagtatctacacaaattatttggactgcttcacaggatatttgcctcatctccaccatttatttatttattcaatcatttatatatatcagtgtggacttacaaatatttattttttattttgggttataataatccaatactactttacttttttgtttctcgaattgttccagttttggtctttgggggctctttcacttgattcctgtgtcccttagacatacttccagcaatgtagggttttagtgttttatttgagcatttacttactttttgttacaacaggatgctctaggctcactttgtattttcacttctttgcttttaattttagttatcttaagagaagctgatagaagatcacagctgatcagacaaagcttattaatgagtctgaaaagcaatgtgacctcatatttttactcatctttcatctatgacttcagattgtagttaagaattattctcatgctttatattggttgtccccaaagtttagctgttttctatgcaagaaatctgcaatttgtgaccaatgattttcatagatttacaatgccttcagtggattttagatttactgaatcaacaatttgtatataaaatatatattttgtatataaaatattgataatattcactttttaaggaattgaaaagttttataggttatattctaatagtaacttaaagtaaagagaggcaattgacattgaaaatgataaataagacaatgattctgagaaaaaaacttaccagtttacatatcctgcctatctatacaaatattctattacttaaacataagtgacagtagagatgctcatgtattacagtattctctcttaaggtctgtcagcattttcattataaacctgcttttcaagggcatataatatctctaaaatttcatttgggatttaaacttgccaaacacaattgcagactaaaaattccttttgaatatttaatcagaatcattgtttttgtcccagtacttttgcttgtgtgatagcgactttctttcttcctgtgtcttgataaatggtttctctcccatctgagagtgatgactgttgaatgagaacatggccttaaattctctgagtttgatgggtagtgtgtaatatcataactctttgattctgcagcaggcaacttccagcagagaatatgttttctaagtggcaatgagtgtttcttattcttctttttttaatggcctattaatgtagtccctatgaattatactgtatttctctgttgatgtgccagcaataaccagttagaaattataaatgtaaagaaaacttaccgacaatatttttaaaataaataatctgtaaattttaggaattattccagcaagaaaaatgcaaggcttatattttcttgagaactaccaaatttttttcgagaaacataaagtagaatttgaataaatggagacatacaccatgttcttgactaggatgtctgaatattaaaaatatatgtttttttctgtttagttgattataggtttatagatacagtacattccaaattaattcctaggttttatataaattcaacaacaaattacctttacttttaaaatgattattctgaagttcattttggaagaataaacagattttaatagttaaaatgtttttaaaacatgaataagataataaaatgcatcaaagttatagtaattactagtgtggtaaaattttaagaatggagaggtgaataacatgaaccagatatccttgaaaaaatattatttttataaaacatcataagcaaaggggaaaataatcatttaataaataattcttggaaaaaatggctatttgggaggcaagtataaaccataaaatctcatgttagagttttactttacactcaacacctaaataatttttgaatcatttaagagttaaatattttaaaagtttaagaatagaaacaaatagaatttactatttaattcctttgatggtgagaaagtattttctaatcataagcatatagaaaaaaaatcacaaaagaaaaagatgctggatttcaattgacagcaaccaataatttttcctagtcagaaagcatcattatcagaatgaaaaggcaaatcacaaatagggaaaatatatgcaacatatataacaaaagcctaatgtctgtaatatataaatatctcttataaatcagtaagcaataatgaacacctctaaaggaaaatgacaaagatcagaataggaaatgaaatgaaatatacatggaaaataaacatttgaaaaatacaagttaaaagcagatttttggacaatcatattcacaaatattagaaataaattaagtttttgtgaaggtgttgtgagacaggcactctcacagttagacttctggaggagtgtaaattagtatcatctttctggaaagtaaatagcaatatgtacaaagagccttaaaaagctattaaactttaacccaagaatcttgtaactagaaaattaccaaggggaaatcatcaggatgtagacaaatattcatatgcaaggaaaatccttttcttattagtactaatgatgaaagactggaaaaaatctgaaagccaacaaaatgaaaacattacaaacattacagtacatcatttataatagaataatgggcaggtatttaaaaccatgtttgtatacatgatttcagttgtcatttgtgtaggtaacatttttttttttgccctgtatgtctccttcctgagcctgttcaagttaaaataaacgattggtagttgagtcaatgagagtttacaaaatttctaaaactctagagagtcactattccttggtttacagttggctcttttggcttgggtaggaatgatgcttttattgtaggcatcaaattacatgtgccacttacttagaggacctaaccctgaaaagacctcagaaactatgcctcagtaaagaactcagatttcactcccaagtaggcatataaaaaagttgaccattcacattctggaaattctctttctttgacttctgggttaatagtctctcctggttgttcaccatatttctaattagtcctctgctgtatccctagtatgatcggggaggtacaatgtagatttctcaaacaatcttttgccgttcaaaatggctgtgctttgggttaagacacctaacctatcattaagcagtatggtgagtctgtgatttggggtcagattccagcctggctaccagttagttggtgactttgggcaaataatgtaacctctctccttagttgttatggattaagaggtgaaatgtatatgaaccacttaattcattgcctgggatatagtaggcactgaaaatggtagctattattgttattatgatgatgtactagggactatggaagaccaatgaatttctacagaaaatactgatgtttttagaaaaaggtacattaataggtaatactactaaagcgacagaatatcagctgagctgccagtctaagtatataagacataaagaaaaaaaaatagttttcaggagacactctaagctagtggcaatgaggcaccatgctttatccacttatctatcccaaaaaccaagcacagttcccaggagatagtagtattcaataaagatttttttgaatggatggatggatggctggttgaggtgtgacaaatcaaagcccctggtagccagtgcataatatgaaggaatcctgtgcatgtgtgtcaggagaagagaggatataagtatggggaaaggggagggaaggctgaaacaaagagaaataaaagggtattgaaaagatctacctctcaactttttgagcaaaatccttcctgtcttctatattgtttgaaaccctgtttccacacacagctaaaacagctgagaacatattggaagaaaggaaacatcttgtggtctcacctacaaacttgagcatccccactttcacttccaccctcctagtaaaaattatgacaatatgtcaatatgataaggcagagactactcctgggagctgttcctaaagtctgtggggatccagaatctaggctaacagggcaataagaccatggctacagtgacctattttctgaaccctaaattgggacacacagtctgaccaaatatttattttcaatatgtggatatattcatgttaacaatttcaagagttgtatatattgtatctcctttaaatgagttactgttattgaaaataataacattctctgaaattagggctgttctaaaaagttggaagcatatcattaccatgttttttggcatctttcaatatatgtggggtttttttgactttcaaaaacttagtaatgtcacagattacagtaacatatgtgtgtgtatgatgtgtgtaaggtcaagatttcagagttcagaatcttgggtagagggatgaaaggatgcattcagcctcatgggtaatagaggagcagggaccaatagatgtggtgttaattagacttgagagataagggtacaaaatagaatctagaccccagaagctcaggaatataaactggactagaaggaggattaagcattcactggaatcaaagtacaataattatttatactatgtaaataagccataagtagatgcatttattcaataggaagctgaatttttgtggaaagactccaggagatgttgagcttaatgaaagaacaaaagtgtacatattcagttggcttcaaaacagaacagaattaagaagtttccaaggacaaaggtgatatccaccactattcattcagtcaacaaacatttcaatgtgccaacagtgtgccagatagttctagacaccagggatagagcagtaagcaagattgatcaagtcccctctttcatggaatttgcattgtaatcggaaagtaataaatgaataaaatataatttattgtacattttaaaataactacaagagtataattggattatttgtaacataaagaggagatgtttgaggtaatggacactccatttaccctgatatgattattatgcattgtatgactgtatcaaaatacctcatgtaccccatagatatatacaactactatgtacacacaaaatttaaaaagaagaaattaaaacatacatatatattgtgttaggttgggataaattccataaagataaacttagacaaggggacaaaaaatgatgtaatgcacctggatactattttagttagctatgattgtcagtggccttctctctgaggaggtgatacttaaacaaataaatgaatgaagtacaggagccagccatacaaaatctggagggaggaggatggcattccaaacagattgatgaataatcaactatgccctcaagtggtattaagcatgcactattagacaaaaacaaagccagccagtatggttggactttagcaataggagggaggcaggggccagtttgtatggggccctgtagatcaatgtgagaattcatcttattttaagtatgatggaatactgttggaggcttttgagcagaggaatcaggtgatctgattcatatgttgtagaaaaacaaccattgctgctagatcaaaagaggttttagagaggcaagaattcaaacagcaaggccagttaagaagttattgccatattctagttacatcctgatggtggtgtggacaagggtaggtggtaaagaatgagttttcacttacatttgcctttcatttatttattttttatttatataaacttaaggggtaatgaaattttggggcttgcatttttgttacatgcatagattatgtagtggtcaagtcatggcttttagggtgtccatcaccaaaataacataccttgtacccattaagtaatttctcattgtccactgcctttccacctccttgccccttttggagtccccagtgtttattactcccctctgtatttccatatctacacattgtttagctcccacttatgagcgagaacatgcaatatttgtctatgtctgtctcatttcactcaatataatgacctgtccggttccatccatattgctgcaaaaaacaagattccattttttatggctgaataaatattccgtagtgtgtatgtaccatgtttgcttcatcaaatcgtctgttgatggacacttaggttaattccctatgtttgctattgtgaattgtgctgcaataaacatacaagtgtaggtgtctttttctttttcattgggtagatacccagtagtgggattgctggctccaatggtagttctatttttagctcagaaagtaagtatttttaagctaaaaatctatataacttgctgattgagtctgtgtgagataggagggaaagaggaatcagggaatgcaccaagcttttttatcttagtaactgtgtaagcagtgatgccatttactgatgtgaaggtgtaagtgttgggaagatttgggagggaaattgaaagacagattttggacctattgaatttgagatgcctatactataaccaagtggaaattaagagaaacagctgtatacatgagtatgaagtttaggctatggtcaggattgaagttataatttaaaaagtggatacatggtattgaaactattggacaaaatacgacaatctagcaaatgaatgcagatagagaagaggcccgacaaacacacactccatataaattactctcactaagacttatttgttcagtcaacaaatatttttgagtgcttatatactaggtgttgttccaagatttggggatacagtggaaaaccacatagataaagctgctgtcctcacagggcttagaatgaaaagttacatgggtgataagaggaccaggacaaaagggtagcagagaaaaatagatgaaaacattgagctttgtaaagaacaaaacaagcctgacatttgctaagccagtatgtgcctgttaagccaataaaacagagaaaatgagtgtccagggtaagtatcggggatggggaagtaggaaatgataagagcccgggatacctccaggagtgtggttggatatttctggagtacacacaggcagaactgaagccttgagaggaatttttagccttttggaaaaatgtctttctcatctccagtagatacagaatagaagatattaacattgtgccagaaaagaaattctggagtcacaggtagacaaaagaccagaaaggcagtaaaaagttactagctcgggctccaaaagcaggaatatattattttatattttatattttcaggaatatatgattttatatttatatttaccacctttagctaagggacttaggtaatttacattttctgaatcctagtttccgcatctgtaaaatgaggagcaaaagtatgcaaagcacctaacaatatgtcttgtatatagtaaacactaaataaatgttagcttataatgatattgattctgattatagtaacaaaggttgagaatctccacagctgagctggtatgggtctccatgatgttcatatttcctcccaaaggaccaaggaaagaaatgaagttaatgaggcacataggcaagctgtgccattcaagaaacctttgatagatcatttttaacttaggacaggcattctatactttgaaaatatgtctggttttatacttattttattttttattaatttcaccctttcacttttcattgtttattggccttttcatatattccctctctgctaaaagggaggtgggatcgagaatctgaatttctaacaagcttccaggtgatgctgatgctggtgctgctttccaggaaccacatcttgagtaacatggagctaggaaacgtatctggaggacactagaaaacatatcagagctgcggcaatcagtgatctgattctcaaataaatgaggcaggataaccgtgattactcctgcttctcatttcagcctccagtggttctcttacattatatgcagcataaagagagaatttggaggcgagtaatggggttagaaaagcaggaatgctgctcatgattccttatagcctccatgttgtcctgaaacagatgtgagtgcacagctgtctactacaaagagagcttctgaggaaagcctccatggagcaatatatcttgcttttatcattttcctctttatgatgttttcttttctcaatcccatgaaaaatcacataatgggagtttactgtagcctgtttgaatggataggacaatggagaaataacgtagtcaagaaactgttcccacaactaaaagaagtttatctgagaaatgtttgtggcagaacataagcaatcattagaaatgaaatttgggaaagatgaaaaatcattcaatataaatcatatattgtttatcagaaatacttggaatatacagaaagattttcattatgattattgagataaaaatgtggctttcaaatatattcttccagtatgaccagtatattttattgcaaaattattccttcttcaagaaaggtcttttataaatggacaatgaaacaggctgtgtattcagatgctactgtctatcctcagatatcttgcttttcagcaagtaaagcagaaattgatggtgacagtcttcctggatttgttggctctttcaccatgatccactctctttataaatgaaacattgagtttcatttggtgattttagatgcatttattatttttatatcttattcagtcttgcattgctatttaagttcatttagttttcatccacagccctttagatgttttgtctgtacttgattgattgatatgagaggcagtattgtgaggtatttcaaagcatgagctttagaaacatatttgaatcctgacggtgctccttattacctgtgtaactctggagaacttgcgtaagctcctggtgtcagtttattcgtctgtgaaatgggaataataatagttcttacagggttgttatgggttacaaatgagttaatatgcataaagcagccaaaactgtgaccagcataactgcaaactcttactaagcattcagaatatattggctaattgtattaatgatgttttatgtaaaccatttcatgtcaatgctcatgttttatctccccagccagactacaaacacattttaggtatgcgagcaatacactttattttctgtgtatttccttcagtgcatttattatttctgtattgtttgccatcatcactatggatttagtttgaagatacaactaccaagggatgcattataaattttaataaatggaacctgcaattaagaaaaactgctaccaataagcagtaggtaatgaggtgaaataaatggaaagcatgtactttcttactaataattaatactaattataataacacctatttctcaagtacctattttactttgttagacactttatttcatctcttttattgttcacaataattatatgaattaggaaactgaaagtcataaaggtttagcaacaagtttcaggtcactcgggattcaaactgactgctcactaattgcaaacactgcattgccgcacttcttttttaaaaatttttgaaatataattcttggtaaaaataactgaattgggttcacataacagttctacttttcagtaaccatgtgacaacttggaattcataacccatatttgtgcagaaagacactgtgaatctaaatctaaagcttctttgtagaatacttcatcctctgccatttccctgccagactgctgctcctgcctccagaaccacatgacttgatcatttattccaaattctctagtcactgccaacccaagactgcacatcctctgttatcataccccagggtttgtcctccttttctgtgtaggtaagagttatgatcatgtagttctgattttccattcagtgagaataatccaaatatgaaaacattgtctttctccatctgtttcaacacttgggctagctatcacattttaattagtaagtagtactctgatgcagtggtccagaacagaaagaaaatgatcaatactgccattccaagtccagatgtactataataagcaccttggacataagtgggatgacttcagttgatttatagtcttagaattggcagattattaagccaccaataatctccttgttctcctttgtccaggatttccctcttctctcctgatcatttctaatttttcctgtccgtagggagtgcatattgggaggaggaagtggtaaaaggtaggagcagatgtggtgagaggtcaaagagcaggaggatctgtgaatgggttttcttagtcccaagcattcttaacatgagaatacgtttcaccctatattgattcagtcacctggaaaatatgtgtcttttttggttacagttccttcatcctctatttttagtccaatttgaatatcatttgcaaactaggaaatgtactctaaatcttcatccaaataattacattcatataaaaaatctgttaatgaaacattagagctaaggtcttaattcgcaaaaaaatcaacccatggagctcaaaaattcagttgagattccatggcaacaggatctattattaactgtatatatgttatctaataacattttgaaattaacctgctagtttaggttccttagtactatatataaggtaagatgctgtttaaaaataagataattttaaaaaataatttgtctggatgaaaattatggaaaacttccagttccttccgattattttattgcttatcaaattttatgctctttttttaatcagttaatgagaaacgtcttcattacttttgaaatacgatggcatttagtgtccaggagtcatatttctgtcatacattttccaaagaaaaaaagtagcagaaagggaaaattaaaacacaaacttaatgaagtaggaaatgctaagaagggaatctgagagagcagatcatcctttgagggaaggaatctggatgaaaaaaaaaattttgaaatgtttaagtatgataaggataacaaaggcatctcaagttgagtaaaaggtattataccctaaaacacaaaaggggaaaactaattcaagttaacaaaaatgaggaagatggtaagagtttttagtaggcacattgttaatatcaaggtaaaaaagattgaatattgaaactagtggatgttaaactgagagcgtctagtaaacatatagagaagatgattcaagagtggcaagtaatgctgagatattctaatccaaacactgcctatgctatagatggcaaaacagaggcccagggccgagctgcaattttaccaaatgcacacagcacaatagtagcagcctcagcacacaaaaatgccagactccactctcccagagcaagaacccatcatcacgagagatccttttcatgatgatgatattcaaacactggaggaagcatttactagaaacatgctgtttattcatcactgtgttggttaacacatgggacccaaaacaggaagccatgatatttaccatgaaaagttttttatcagtttgggaagacaatacataatatatttacattaatatctacagagcaaattcaagttcaggtaaaacataaagatctaaaagactacatggtgcagaccatacacacgtttctggcatgattccaagtaaaggagagatctgttagggtatgatgtgactttacaatgtgatgaagcttcaactgctggtgctatattgactctaaaaggaaaaagctaaacattgacctttgtaagagtagagatttaggttaatcataaggaataactttttactgattataaaacatatagaaatcttactttttctatagtagtttttggatttaggaagaagtcaaaggaaatataccatgcactccttactcttcagtagcttatggtttatttgtagagagaagatattcattttgaggtgtaagatatagataaggaagtttatgattatgtgacaaaaggaagacacatgggaaatcaaatgagaattctagaatgatctcagagaagaggaactctgaggattagtggcagcatggtgatgtggaaatactgtaagccattatgtcaaacaaattgggttaaaatgcaggctctgatacttactaggtttatggatttgctgagcctatgtttcttttcctgaaaaactagggatgtaatacctaacttgtagggttcctatgaagagtgtcaacaatggatgaaaggatatggggcttcttttggggatagggaaaatgtttgaaaattgatcatggtaaaggttgcacaactctgaatatactaaaatctaccaaattgtacattttaaatgagtggcttttaaggttatattctgtgcctaagtatatatacaagagtaatgaaaacatatgtctacataaaaacttatgcccaaatgttcataatagtattattcctaatagccaaaaagtggctataccccaaatgttcatcaactgatggacggataaacaaaatataatatatccatacaatggaatattattcagccataaaacggaatgaagttttgatacatgctacaacatggatgaatctcaaaaacattatgctaagtaaaataaagcacatgcaaaatagattgtgcaaacctattgtacaatctcattcatgtcaaatattatgaaaatacaaacctatagagatagaaaatagattagtggttgccaagggtggggtatggtaacaggtagtgattgcaaatggccacaggggacacagggagtgttttggagatggtgtaaatatccaatgtaaatatcctaaagctggtttgtgctgatagttgcacaattctatcaattaactaaaaataattgaattatatgtttaagtgggttggttatatttcaataaagctgtaatggattcaaagtgttaagtaataaatgctcaactaacagtagcttttttgttgtttaagtaatcaggaaaagcctcctgaaggaactggagttttaatgatgagtgacagatagctttgcctagatgatagggaagtgggaaagtgaagaagaaataataggaaaatagtatgggcagtggcctggagagagaatagacctggtgtaatttgtcttactatagagctgactagactaggaagttagtactagggaatattgggatagttgagagataagaagctgttggaatcagacctaagactgggaaaggactggtaggatgtgcctcacatgtaccattgatgagtgggtagaaatgaagagattcaagtgatagaggccccagatgatagagatagttaagatatggcttttgtcgaggagcagtgggcttcctgggtgctagaaatagaattattctggctgcagctggctggtactgatccaaaccatttagaggctgagctggggaagattgtagatggtaggatatggtgtggtatggtgtggtgtgatatggtaggtgcctaagcagtaacttgtgtctgggcaagtaggttagaagggccagcctggggaagcagacccagagtggccaacctgggagtcgaaagggtaaaggtgatatggtggacccatctaggttaaaaaaaaaaaagaaagaaaaataaaagtgatccagctggttatcttttctctggctgctcttggagtcatgtgagaactgactaaactgtcttccagtcttgtgagttatttaagtaagcagctctgtcaagattatgccctccagctttccaacaaatctagtgaggtcactgggggagaaatctccaaatgtcttctcaaagttgtatagaattttaaagatttcccgcccaacttgaggcaaatccttacagtgcttaatctcagtgatgtgataagatcatgactttttcagaaatgtctttgatgtcaatcctaattctgctaaattttacctgacaaggaaagaatgaaacattataagctagtttgtcaagcatctcagtaatctgttttggcaataatctgttccagttcagccctgcaatgatggggtctggtgaatgatgtaccttgacttggaaggaacttattaagtgttcaatcattgattaatgaagtaaaaatgcactaggtagaccttgaagtgaaaaactggacaggaaccttggcagacattagggcctcctgcacactatccatactgtgatttattttgaaaatgatgactactcctttttttacccacatacctacaatgccacagaaagaccagtgttgacaatcaacagatacagaaatgaaaaatactgcaggtgactcctactttgagttttaatcaccattataaaagtgaaaaaaccataaaggattagagttgtgaaagcccatttttcctcaaatggcctttctgatgtgtaaattttaaaaactatgctatcatttttgataatataaacataaaagatcaaggaaattgaaattgcagttttattttttgagatacattttatgattggtcataacagcaaagtaagtaagtgatatttttcagttgatcacccattacgttttagaatgttttaaatcccttcatcatcaatgtatcccgcgtccccaaagaccacagacactacacctcacaaactgaagaaatttggttagttttgcattttcttcatattgcttgcttttcttaattttttcataagttatcgggttctttctgctaaaatttacctccatgcctacatagattattgagttcttagaggattaataacatacaacatacaaattttcctgccctctgcttttgtgcctcaatgtgatgcaaaaggtttgatctcatatatttgatatttgtgtagactagcagctcatgagtccctattgaggcatgtctatcatgagtaactttttttaattctctgggttaaattttaaattttctttgaactttctttttagagataatctctcaatgtaattataaggcaaatgaccaaaacttcctcctttaacataaaaaagaccttacataatattattatgtgaatgtagcgtaagagcataagatttagtaatgtataaaaccaaggtgacatggcagattccatcagatctgaaaggtttaccagtgctgccttgcaatttcttttttttattttattattattatactttaagttttagggtacatgtgcacaacgtgcaggtttgttacatatgtatacatgtgccatgttggtgtgcaatttctttcccaagcttctgaagatttcttgttcattacacccctcaaaactttgagtattatagtcccaaaccttgcctaatgacacttcctgtgtggacaattcatttaccaagaattgcagttttttaaaaaatgaagtgagaagttattagtttaataacacaaggtaactcttcatgtcttggtgcccaataggcactcttataaattaccgacaaattacagtagatggcaattcctgcactgctgccactgatagataaatctatgccatattattctggcttttattgactcttaaaacagcatcagattgattttagagtagcaaggatataaaataaatacacaagatacctttccaataaaggaaaggaaaaccagacttctttgtgtctgagaattctagtgttgaaatggaagaacatttctgagtaccttcttgtttcagcatgaaaattgtttcctacttgactttaaataatgcagagctagttttttgtagaagaaaaaaaatcacaggactgagaaaaaggaaacccgatattttagtccatcctgtctctgtcactaacaagctgtatgaccttaaataagtcatttaagtttcctgtgccttggttcccacctctgtaaaattatataattgaatttgatgaccttcgacactgcttttggttttaatatcttatagtttattaatatgaatgcaaatagtaccatatgcattatatttatacttatatattttatttatatgatctgacagaaatatatgaatatagagtttgaaactttttgaagacaaaaaagaaatggctactgaaacaggctaataataataactaatatgtgtctattattaatcaattcaacaaacatttataaacacctaggtgccctatcactggtaggtatagagaggtgaaaatgaaatattccctttttctttatacataatagtgaaggacgtggatcttaaatatagaaaagtcttgatttactaaaatatttagggaaggggatgttaattgaggctttttaaaattaagtagcacatctatcttttatttcagtctttgtggttgaaacgtttcatgtaactgtagtccattttactactttaataagtacagttaagtgaacataattgcattttactttattatttggaacattttttcagagtctcaagttcatcattctgaaatctgttcttattgtacgggaaaagtaggagattgggatgaatctctattgacctcagactacttcttgggagatgaatttatttttccttcagtaaattcaacataaaggcttgcttagtcaccatgtctgtttttctcataaaaatgagtgtagaacatgaaataaaatgtttcattagttggacttcagttaattaaggttttactgtacataaaatcctaattactaacagagagatctggtcgcttttgtgggaaatagtatgttcagttttgggtgtgaaatttggttaggaacatagctggctacatgacagtatccagaagatctcaaccagaaaggtgaaattagagcatgtaacatgcaaaatggtaaaaggaaggcaaattggggtgaagaaataaattaaaaagaggatatatccatcttctttctgtttgaagagctgatttgtagaagagtgagtagaatgtccagtctggaaggaacccaaaaggttatctgttctaaccccttctcttatacatctgttcatgtagtatttgatttccttctacatcattctgttaggtgactaggaacatctggagaacttcaaaagcaaccatttcatccatgattgcccctgttagttcttcttcatattgagctcaaatctgtccacccaccagtttgaggaacacagaatacatctatttcccttccacattacagtcctttagatatttgagaacatctaattttacagaggtgggaaccaaggcacaggaaacttaatgacttatttaaggtcatacggcttgatagtgacagagacagacaaacatgtcctccttggatctaatttttactcccctgaaccttaacaagtaaacttgttctccagaaagtgaagttagtaccaagatcactctcctgcttaaaaactactgttggagtaaacagcctacagaatggtagaaaatattcgcaaactgtgcatccaacgaaggtctaatatccaaaatctacaaggaactcaaacaacaaggaaaaaacaaacaactccattaaaaaatgggcagtgggcataaacagacatttctcaaaagaaaacatgcaagtggccaacaaacataagaaaaaatgctcaccatcactaatcatcagagaaatgccaatcaaaaacacagtgaaataccatctaacactagtcagaatggctattattattattattattattattacttggacacggggtctctgtctcccagcttagagggaagtggcgtgatcctggcccactacagcctcgaatttttaagctcaagtgatcctccctcctcagcctactgagtagctaagaccacaggtgcacaccaccatgcccagctaatttttaaaatttttttgtagagacaggatgtcactatgtcacccaggctggtctcgaactcctggcctcaagtgctgggagtataggcatgggctaccaggccaatctggctattactaaaaagtaaaaaaacaataggcattgatgtggatgcagagaaaagggtatattggtgagagtgtaaatttgttcagcccctgtggaaggcagtatggagatttgtcaaaaaactaaaagtagaactatcattatttttataattttttaaatttttattttattttaagttctgggatacatgtgcaggatgtgaaggtttgtaacacaggtaaacatgtgccatggtggtttgctgcacctatcaacccatcatctaggttttaagccctgcatgcattagctatttatcctgatgctctccctcccctgtattcccagcccccaacaggccccggagtgtgttgtttctctccttgtgtccatatggtttcattagaactatcatttgatccagcagtcccactactgggtatctacccaaaggaaaaggaatcattacatcaaaaatacacctgtatttatcagtttattgcagcactattcaccgtagcaaagtcatggaatcaacctaaagaaaatctacaaagaatttacaaagaaaatgtggtagatatataccatggaataccatgcatccatagaaagaaagaaatcatgtcctttgtagcaacatggatggagctagaggccattatcctaagtgaaataactcagaaaaggaaaattactgcctgctctcacttacaaatggagctaaataatgtgtacacatgaatataaagatggaaacaatagatattggggactccaaaattggggaggatgagagggcggtgagtgttaaagaaattgcctgttgggtacaatgttcattatttgggtgatggatgcactagaagctcaacccccccatcattcccatgtaacaaacctgcacatgtatcccctgcatctaaaacaaacaaacaaaaactactattggcttgtgttggccacaagataatgtacatgttctttattgtagtatttaaagctctgcctacctttggccttgattaacattacttcttccatggaggctatagtccagctatcctggacctgtccgtttcattaacaaatcatttattttgtcttcacttatgcctttgttgaatgcttttcctcttctggaataccctgctatcccttctgaggccagtgcactttcaagtaattcttcaaagcccagatcaaatctgttctcttttgtcaaatcttcctagacttctcttcatacctaccttcttctctctgaaaacaagtccttaatatatccttatactcttaattatagcccgtgcccctgtgaaatcattcataaaattttatcctgttttgtttttatgtatttccccagctgaaatgtgaacttttgaggttaaataccatgtcttgttcatatttcttttctcagatttaacatatttgaaaaattaatgtataaatatctattgtattttatttcattagtcatcaactctattaataaattttatggaatgttacctaattttacctttctggagtgcgatgacgttttattcattcacttcatttgttagacatccatcatttacctttcttctcaccctttgtctttccagattaaacaaacttaaattctttgtctgttccccattccgttaattaagtctttctggatttttttccatatctcatggagcaggaccccaggccaggcctaattagggagcgctatggcaactgatagcaccattcattttaggtgaaaaatattaaacactgtcacaccaccatcaccacctcttttcattttagcttgcttttcccaggacagctcccaattctcattgaattgcagagcagttgcaattatttccaagtcagtggcttattattagtttgtctctctctgctcaacagtgcaaatcagagtgtgttttacttaaaattatgtgcattttagtgtatggtactagaatgttagctcttactctgcctttgaacatgtgtctttcaaagcattgtaggtcaactctgaatcaacttttcactggaatttatagaaaattttaggctatttcaaagccaacttttattctctcaaaaaaagaagggaaagatgagaaggaagagtataaagagttgaattagaagcctgaagtcagtttctttatgtaaaagtttgaaaacaaaagcatccccttttgaaacaaaacaaaaacaatgaacaaccacttttagaagccagttcagactttagctgtgttaagaaaagccatggcctgctacctagttcagacgtgatagaagtttgcctgcctcaccaatagtctttgagcatttcttttgatgactgaactgagttactgaaagcccagataagtgagacaataggtcaactggaacccaagaagtggtgagcagaggtgaatgctttttaaaatagagaggagcaaaaggaaaagctttcattagataaactatatatttccctcgctctgtcaaagaatagcatttcagtttttttttttccctagaggttctggcaaaatttcccttacctggaaagctccaatgtagtaaagtgaaaactatttgagcaccaatgttgttttgggaataaatggtctaaaatgcttgaggagctactcatgtcattggatttttgataagattggatttttcccaagatcccttgacttagattctaagaaaaaataaccctttctttggggactttgaggcaaaaatgagctgttcatatttgctgtccatctctgcaaaccaaggttctcttatggtgagaagtgtatattgattatctgagctgccacctctgttacgcagaaaaaattacatttgcaaatcactcaggggaagttcatagcaggggatcccaagctcactcctgtcttatagagcctctgaacttcactcctaagcattgcattttggccacaagttccttttctgctcgatcttacacttcctatgccaagagtcagctcattaaagaacaactagatgatattccaccaaaatgaactaatgttttaaaaaatggacataagcttaaataaaccaaccaaacaacaaacaaggcaacgtgtgaagcaattaggactgaaaataaaactatgtttgcctgaatcaccaaacttaaagttctcagcattctctgcactgaatatgtagcatggcaatatttcatttagtttgattcactaagccaaatagataatttgttttcatgttttgttataaactttgaaaaaaataataaaatattattttaaaattaacacagtgtcaatagaattatactatattttcaatctgaaagtgacattagagaccatttcaactgactgcctccttttttaggttacaaaattgagacccagagaaaatggactaatgcaggtcttatataaccttggtattctctcagctcagtgatctttccaatactgcaagatatcccctctgcagtgtacactttgaggattgtaatgtgaagggaacaataataaaaagttacaaattgctgctaattctctacctcccttcattagcataagtatgtaagctcagaattgtgcttattgggaggagggactctgggctaaatgtcagtagtagatagaactagggaagtagtcccagaccatctgcatttcagagaaaaactgacccaggcataaatgatccatggaatactcttaacgttgtggcaaccctgtgttccttggtttccagcttcctctcagctcccactcttagttaccagcttcctaccagtttgcccttcataaggcttagaaaaatctttttaagtcatatattcctgttacttgagtcctttccaccaatttcttcacaaatggctattaaacatatgcaaggatgacacatcttcctgtcattcagctatcttggtcactctcttctgaacacattctatttgtttcatggtcttttaaagaggaggagcctacaattgaacacagactccaggtacactttgagcagctgaaatcagatcaagaatattatctttttctttagagtccacatttccatttacacagcctatgctcacatcacccacatcatcttgccagctcattgtgcttacagtcaactaaaatcttagtctccatatgcagctatttttataccaatttttgtttccatgtacttgtgtagtagagatatttttacaaatgcaggactttacacatgaagggacttgaaaaagtttatggaaagtggaattaaatcataaaaattaaaagttgtatactttatttctcaacataagttctatcaaggtcaagacgcttttgtaagtgatgataccagccatttagtctttctctaaagaactgaaggttctgggaatttgaccatgtcaatgcagtcttttttacattattagctgaagaaaaatgggtggcctttacagatttttaaagattaggaaacaaaaagaagtcaaaaggagccaaatcaggactgttaggtggatgcctaatgctttcccattgaaactctcacaaaattgcccttgtttgatgagaggcatgagcaggagcattgctctggtggagaaaaacgcttgttaaagatttcctggacatttttctgctaaatcttcctctaaacactctcataataagcagctgttatcattctttggccctccagaaagtcaacaagtgaaacaccttgagcattccccaaaaaatgttgccatgacctgtgtttttgacctgtctgcttttgctttgactggaccattccatctcttcatagccattgctttgatcgtgctttgtcttctggattgtgctggtaaaaccatctttcatcccctgttacaattctttgaagaaatgcttcaagatcttgatcccacttgttttcaatttctactgtaagccctgctgttgcctacagctgatctgggactaacagttttggtacccatcgagtggaaaatttgctcaactttattttttcagtcagaattgtgtaagctgaaccacttaagacgtctatggtgttggctgtaatcccagcactttggaggctgaggcagtggatcccgaggtcaggagatcgagaccatcctggctaacatggtgaaaccctgtctttactaaaattacaaaaaatttagccaggcgcggtggtgggcacctgtagtcccagataatcaggaggctgaggcaggagaatggcatgaacccaggaggcggagcttgcagaaaaaaaaaagatgtctatggtgttggctattgtttctgctcttaatcattggtcttcttcaattaaatcacaaacaagattatttttttccacacaaattgatgtggatagtctgccactgcgggtttcatcttcaacatcatcttatcccctcttaaaatgagttgttcacttgtaaactgctgatttggggagggcattgtccccataaactttgtgtaaagcatcaatgatttcactattcttctacacaaactttgccataaatattgtttttttcttgcttcaatattagaattcatgttactctgatatgtgctctcctgaacagatatctttcttttttttaatttttctttcttttttttattattatactttaagttttagggtacatgtgcacaacgtgcaggttagttacatatgtatacatgtgccatgttggtgtgctgcacccattaactcgtcatttaacattaggtgtatctcctaatgctatccctcccccctgcccccaccccacaacggccccggtgtgtgatgtcccccttcctgtgtccatgtgttctcattgttcaattcccacctatgagtgagaacatgtggtgtttggttttttgtccttgcgatagtttgctgagaatgatggtttccagcttcatccatgcccctacaaaggacatgaactcatccttttttatggctgcatagtattccatggtgtatatgtgccacattttcttaatccagtctatcattgttggacatttgggttggttccaagtctttgctattgtgaatagtgccacagtaaacatacatgtgcatgtgtctttatagcagcatgatttataatcctttgggtatatacctagtaatgggatggctgggtcaaatggtatttctagttctagatccctgaggaatcaccacaccgacttccacaatggttgaactagtttacagtcccaccaacagtgtaaaagttcctatttctccacatcctctctagcacctgttgtttcctgactttttaatgatcaccattctaactggtgtgagatggtatctcattgtggttttggtttgcatttctctgatggccagtgatgatgagcatttttttcatgtgtcttttggctgcataaatgtcttcttttgagaagtgtctgttcatatgcttcgcccacttgttgatggggttgtttgtttttttcttgtaaatttgtttgagtcattgtagattctggatattagccctttgtcagatgagtagattgcaaaaattttctcccattctgtggttgcctctgaacagatatctttctaagtgcctcaaagtagatcctgttcacacatgttataacaagttagtgcaattttattttggtgcaaaaaaattgaagtccatacgtagtttcttcataatatgcttcttccatgaacgttttgaagtctctttgtatctgtctctgaaattataatgtgttatatttggctcatagttctatcctggcatgaatttggggcatgatgattgtcattcaacaggctagttactcctactagttctttgttatttacaaactatattttctcactcatgacttggatacaaatgtcatagaggacaaggaaaaggagatcactagagacaaattaatcagctactttaatatggttgttcattcatttgtgtgttaattgtgctgtcatttatctcatagtttttacctcatccaatagcatattataagatactttgcaaaatgccttgctgaatgtgaagcacatctacccatttccctgtcttgtcaatttaatcagcctgctcaaaaggggactgaagttagtctggcaagacatattcagagtgtgcccatgctggcttctggtgctgattgctccctagtatcagagctaagtcaatattcttggaaatctttcatgagggcccagaaacataaatattttcaacactacctcctcatgaatactggtcttttatttattcttactaaggattctgttattatttctggttcaaaagtaaatctctttgacagaaaaggcagatgcaaagtaggggttatctattgattccaggaattgtttgacaagtagcatcattacaacagtgactttaacaatgctcttatttactcatttttaatgttgcccttcatataactaaaaaagtctccagtcctgccttttttggcctccacatcttttatgagttgtattaggttttgtgagtcagaccttattcttgattatatgcactgatttttatcttttagaatcaccatttaaaaaatacggctttgtcaaaaagttcctagttgcagctatatcttaatcttatggaaatttcccctttattctgtcagtatttctcagataatgatgatgatgattatggagatggcagtgataacaacaaaagtgttataatagctaacatctattaaatgctatgtgccaggaactattctaagtgattttttttcatatcaattcttttcatttttaaacaatcatttgagataaattctataattttctccatctacatcttacatatgatcatatgaaggcattgagacattaagtgacttgccccaaatctcatgattagcaaatgttagagctggaagctctgcattctgatttcatagtttggaatctgaacctttcactctattgctcgagaacacaggttagacactgaaggattgaactgttagggcaatcatgatacagtttcagaacatctcataggcaaacttgtggggcatacagagttagtgtggtggtgtgatctcggctcactgcaacctctgcctcccgggttcaagcgatcctcctgcatcagtctcccaagtagctgagatcacacaccactagtttgttttgtatttttagtagagatggggtttcatcatggaggccaggctggtctcgtactgctgacctcaagcgatctgcccgcctcgacctcccagagtgctgggattacaggcatgagccactgcgcccaggcagaattagtttttgacatgcttcacctcctcttctgcacatacagctaccctcactgtatcttgttgccatcatctgagtttcctctacttgtatgctgtccttatctcttcagcttaactttaaggttctgaagagtacggtttattttatacctactcctttgtttcccacatactgtagccaagcacaatgctaaacagggggcatatataaaatccttgtggaattaagtgacaaactttgcaattcatatgagatatgttctcctagaggaggtatgcatgtgtgcatgcacggtcatgagctcacatgcattctcaaaagaaccgtgggcattaagggaaacaatgcttggcatggagcaagtactcagcaaatatctgggaaataaataaatgaaagaggcagagaggaagagagagtttccctggaataagatcaatatcaattgtccccatttcttatttctgtaaaatacatactcttttgaaccgttaattaattgatataacacattaacatcttctattcaaatcggttgtaattatgcaacaattttcagtaatttaattacaaattaaattaaaaacatgagggtgtaccagtgtggaagtatatatatatatatataaaatctccaagaaaaaagaaaaaattatatttcatgatttggaggataaacaggtcgactcctagtatcattcagctaggtgaatatggttttattatcttagtatctggctaaattctgaggtgcaaattgactcagacctattcaaatttaatatcagactttagacaaatcctttcataacaaaaaataaatggagaacatatgacggcttaggtcttttttatataattatatggttcccagagggaagttataattgaattataagctgcctcgtgagtattctagccagtgtttagagaaccacaaagcagagctgagcaatttttttcaccagctagaatgtgaacaagacaccctataattcaattataactagcctccaggaaccatataattatattataaagtagtttggggaaactacaaaactgaaagtttttcaacacattgtatatatttttaaaatgataatttgataattttatcttatgtctcaagtgtcgtgaccacagagatttgaaaacactatttgtagccttattcctatgcacttttcaaaacttttgcgacaaattatcattctagaggtccttagattactttaccttcattgtagatctgtctgtagacccatacacatcacttaaactctttgatcctcagtctttccacctataaaatgatgggatttgacttaggtgatctgtaaagtactttctaacactgacactaattgaatcttgtattagtcagggttctacagagaaatagaacaaataggatgtgtgtgtgtgtgtgtgtgtgtgtgtgtgtgagagagagagagagagagagaggagagagagagagcgaaagttgggggagagagaaaaattgattataaggaattatcttacgcagttatggggcttggaaaccagcaggctggagatccagggaagagttgatgttgcagcatgcgtctgaaaggcaatctgaaggtaggattttttttttttgaggcttccatacttttaaggccttcaaccaattgaaggcattatggaaggtaagtggctttactccatgtctgctgacttaaatgttaatcatatctaaaaaacaccttcacagtaatatgtttctttctgtattgggattatttcacatagcataatgtcctccaggcctattcacattgtggcaaatggcaatatctcattctttttcaggactaaataatactcctttgtgtatatgtaccacagtttattcatttgtctgttgatgaatacttagaaggaaaaaacattgcatgatctcacttatatatgtggaatctaaaaagaaaaataattgaatatatagagatagagaaaaaacagtggttagcagagttaggggttgaggaagatgaaatgaggagatgtcggtcagagtacaaagtagcagatatgtagcatgaacaagtctagagatttaatgtacaacatgaggactatagctgataaaattgacctgttgcgggattcatgctaactgtgtagattttagctacttttgctacaaaaacaaaaaaaaatgggtaactgtgagatgatagatatgtcaatttgctttgctatagtaacttttttactatcggtatggatcccatgttatatgccttaaataaacaaaagaaagtttattttttaaaatattaataccttcacagcaacatccagacttgtgtttgaccagaagatgggtaccatggcttagctattcacacaaaaaataaatcatcacaaatctgtacagtaagagaatggggtgttattcaggtcctacttcttctgattgtggattgtcttttagggatatatcttttaggggcaatttcattcctttttcatccataaaaatgaatgaaattccatagagcagaaagtaggctactggttgtgagggggtaagaagagagcaggaaaggagaagtgactactaatgggtgcacagtttgtgtgtgtgtgtgtgtgtgtgtgtgatgatgatgaaaatgttctaaacttagttgtagagatggttgcacgactatgtaaacacactaaaaaccattgaattttatactttaaatggatggcatgtgaattatatctaaataaagttcttaaaaagtaatgtatacataggaaaagaattcaaagcaattgaagagtttgtaatggaaagtcactctcaccccagtctgcacttacccccaccccattccacttgcaattacagtagtaaccactgtcaatattcctgtattcccccaaatattgttctgtcccttgacttttcagtcaatattgtttttttaaaaactttctgtatccccatatatacatctttaccattctttgaacagctgtctagtagtccgagtattaggcagatgcaccaaaatctaaacatttccctcctgaggaattctgcattcttttcagtgcttgtgaaaatgctgcatggacactctttcatatctatttacaagacagtgcaaaaatatatctgaagaataaattattacacataaaattgtctagtcaaaaggaatgtatattttagattttgataagttattgccgcattgccatatacaatagttgggccaatttatactccctttgacagtacttcacagtgtttgttgatgcattaacactggatattatcagactgtttgatctgtgtcagtaggataggcaaaaaatgattcctcatttcagttttaaacagtgaatgagatggaactttttttgtccatatgcatttcttttttatcaattttatgtgtgctttgtttatacttctattgtgttatcggtctttttattattgacttctaagatctcttcaaacattaagaaaattagccccatgtttgtcataaatgctgccaagattcaccactttttcttttgtctttatattgtgtttatgatactttttggatggatacatttttaaagtgttcattttgttgctttcaaatagattggattgtacaatagaaaatacagtccaaactgaaatcacactcttatgtcacttattttttgaatagtccatgaagctccctctggaggaaaccctgaaactgtcagtggtttcagtattccactgtgcaatatcctgtcctcatggatattggatatctcttaattatcatcctgaagtttgctcttagataagggtatttttattgtttattttaattggccacagattgatcaataaaaacatgataacattgaacagatttcagatattttttcctttgccagggctttctcactttactcaatatagcagctgtcactgtgcttgcattatttgctaatttaactctattactcctttcatataacacataagggtctttacaacacacatttttaacatggagacaaaaagtcacataaaatggtttaatgtacaaaatggaattataaacataaaagactggaaaataggatattaacttttggaactactttacttttttcctcccctctctctttctctttccttccctcactcatttctattttcatatttttccttctttacttcttcccttgttattatgaaagtaatacatacagtaatgtgtgtgtgtgtgtgtgtgtatgtatgtatagatatatcattacaaacagaacatataaaataaaataaaagctctcctgcccaccccggtcacttgactctccattcacatgcccgagagggtataaattttctttatgtgtatttcttgaaattctatgtgagtgcaaatggatgggtatgtattagtgcatgtgtgcacattagaacatattatcttgcataaaagatatatatatgcataaaaatgagagagcatcctttaggaataatcgactcaggctgtacattggttctaatactgtcttcgttaaaaattttcttgggatttctggttattgcttttagaccttgggaattctcattaaatatttttactggtggatttttttttgtttgtttgaagagggatttgattttggggaaaaaccagagactatttggagtcaagtctgttgaagacaggtgttcaaaatatgtggtatgacatgatcaaaaatcagtagagttaaaaagctgattgttttaagcagctcatagacaaacattacagataattatcaatgaggttttacaaaaacgtttggagtactgacagcattgttggtatgtttttggtattacaagggtgacagaatcaattacggagctggagttcatttgaatgtatgaattctactgtgctggtttttggatttcagagttctgctgttctggttacaaaatttgccttagatcttctccctacaggcctaagaagcatcattctaggtcatcagtctgctgcatccagcacagacttctgcttctgacagtagccctggggtataatgacaatcttagaaatgaggaagagcccctggattttcctgcagatctttaattaccagtggtacaatggctctttctttcattaaaaaatctattatttaaaaaagtctaattatagtctgtttctgaaacagataagttgtttcagtttagcttaacttaatttcttatctcttcagataagaaagctatacatcttaagaaattctctatcaccattctcaccattcatattgagatttttttaacttttcaaaagctgtcacttagtgaaataattattatagcctaacattcaataattccttgcttaaagacagcttatattttcactggctttgatgaccagtacaggaatttagaatttatattgatgaagagaacaataataatcttgccaagttttggtaagaaccatggcacatataattctgttttttttttcattctgcaacatacgcaaatatacaaatagtagatgcaacagaactaggaaaaacattgattgcactatgctgtaaagaagatttatggtactgtgtgtggacatgaaagtaattattaaagccattaataagaagtgaaacttgatttctaagcatgatagagtagataggaggacgctaatgttttggactgttaataagcgtcctgaaaatagtccctggctttcaaaatgaagaacagtgctctagaatacctgcatatttccttcaacaatttttttcttataagatacatagcaacacaacgtcgattcacttatgttttaaatacataattgttcaggtttataatgaaactctgtcaggtggcctgagcttcttgttcaatgaggacatccatgctcctcggcactggtctgttccttttcagaacatggcttgtcactgcaaaggaatggacaaaatgtgggtatgagtgtctttaagtggttttattgaatttatatttgcaaaaatgccattctttcattcaaaaagtgtattgaatacctaccgtgtgccaaccactgtggtagttggtgggaaaatagaaataaagtagatgacatctgcccttcaggaactcctaatctgagaatagaagttgaagtagggagagatttgattatcagggcaatcaaatatataatgttctggaaaagaagtatcttcacggcagtgaaactaagggctttctcaatctcttcctccattaaaagaataaataaaaagcaaacctgtattcaaatcccagccctgacacttagtagccgcaagacgtggtgcaagttacccaaattctgtgaacttcagttttctgtctgtaaaactgacgtaataataatgaccatacagaacttgagtgcactttataatgtatacatgtgatataactagtcttttgtgaacagtaaataaagggcaactaggatgatacttattaatatataatttgcttatgaggatcgcatcatgtattactgagtttttttctttttggaaataagacttttacaatttagaaagtgacggatattggagaagaaaatgactatattttccgaaagccttactagcacttacagaatacaccaaacatacttttatgctgatatattttgtatctgtccagcatggcatgcatgttatgcttcccttaaacacagtaatttcacttgccaccgaactgtctcacacatttttcctccctctttccctcacaaaggtcatgccaagaaaggcagtgcacagaaaaatgttaccctcgcctcctccacatgtctccgttctattctctggtatcttccttgtcaaatcagactcactttaagacatcaaaagtcagtgttgaataaagaaacaaaaacacttccacctgacttatggcagaaactccttctcttgctgttttcttctctctgtcatttatgttgatggttttaagctttttctacttaatggtgaaatattcagtcatttggaaagaaatcagccaaattatttggctatttatagacaggttttttttaaactgactgcacttctggaactttttatcatattttggacagacttaaatgtatctctcaaacaagagacaatatttgccttggagcaggagtgtcaactgtgttaatccgttctcacactgctgtaaagaaatacctaagactaggtaatttataaagaaaagaagtttaattagctcacagttctgcagactgtacagaaagcgtggctggggaagcctcagtaaacttataatcatggcagaaggcaagcagaaaacaggcacgtcttgcatggccagagcagggggaagagagatgcggggaggtgccacccacttttaaacaagatcttgtgggaataggatatcctatatcctgtatcctcactagttacaatcctgtgcagaaaaaaaatcactatagatttagttgatcttgggcctaccctgtgactaaatgctgatactagtttacttacctcatggtagaacgatggactttttaaagctaaaaggtccttagaatttgattagtctaatggagttctcaagtttaccttttactttttaagcaacagaaagtgttttgttttgtttcattttattttgttttggcatagtggtttagagcgtgggtggtgaagccagactgcttgggctgaaatctgtgtctcttatttactgtcttcaagaacttgatcaatttacttaacttgtctgtgtctcaattctctcatctgaaaaatggggatcatattaccacccatttaataggctttttctgaatattacatcagccgatacatgaaaagcacttagaaccccgctcagcacaaagaaagtgacatttaaatgtttaatatgtcttccaaaaagtaatcttttatagaacccaaacctacgatacagcaggcaaaataaaagctactctggttgaatggaaaagggtggcagaggtgaagcactggtcagccataagccacaccccaccctgcagccactaccagtgtacctccatttccttttccactagtaggggaagcctgaacataatttgaaaatctgaaaatactttgaaaatcactaatctaagcccatcacttctttttacgaatgagaaaattgcttcaggcatattaactcatttgatcttcacaatagttcccaattttttttcaaatgaggctcaataacttgctcaagcttatatggctagtaaactgcagagatgggattcaaatacacctagaaaagcaagccaaagggtacagacatttttacaggttagctaccacatctatcaactgcaaagaacacagataccttctccaaagaggctctttgattttggagtcatctgttaactttgtttaactacaattaaattggaccttagtaaactagagcacaataaatattaaattattcttctctaagattctcacagtctctttctgtctttttgttatagttttagcagctttcatgtcaacatactatcttaaaatgttttaattacaaataaaaggtaactttgtgaggtgatggatgttttaatgagcttgattatggtaatcatttcacaatatgtacatcaaagcattcacgttgtataccttgtatacaatttttatttctcagttatacctcaatcaaacgaagaaaaaataaaaatttaattaaaattgtgccatttttggaaaatgtactttagggaacaacaatttcactacttccgttttctgttggcgaagcccggaacatttgtccttctcttaaaaacactcagtgctgttggacagaagactgggggttgtatgatctgttttatttgagagatgtgtccactggattaaaatttttaaaaatatttttataatatcaatcttaatgcacaatatgaactaaatacccttttcacattactcttattgtgtctttaaaggggttgggaaatctagtcatttccttttattagatatttggttgtgtggcactattataggagttcagttttctcccacaagagggtaagcaaggttttggtgccttaggtattggtgactctcctcagtgtaaagtgtcttcgattaaaatcaaatacattaaatttctccagtgcatccaattactttgttaattgaaaaggacagcattcagtttaattatgtgttctcgtttctggcaatgcaagaaacaaccattcgaagagccatttggtactgttcctatttggccctgtccatttgagatttcccaattttctgtgattttggtctgtcgtcctaagtatggtttgtttgcttcactgattacttccaacagcacattaaacgcccccatgggaccatgctttctgtctgacatttgatattgtttctgctgtcacttttaagattctacatttctccttgtggttttgatttgcatttctctgatggccaatgatgatgagcattttttcatgtatctgttggctgcataaatgtcttctttcgagaagtgtctgttcatatccttcgcccactttttgatggggttgtttgtttttttcttgtaaatttgtttgagttcattgtagattctggatattagccctttgtcagatgagaaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcaggtggttgtagatatacagcgttatttctgagggctctgttctgttccattggtctatatctctgttttggtaccaagaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattgtgtgaagaaagtcattggtagcttgatggggatggcattgaatctataaattaccttgggcagcatggccattttcatattgattcttcctacccatgagcgtggaatgttcttccatttgtttgtatcctcttttatttccttgagcagtggtttgtagttctccttgaagaggtccttcacatcccttttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgcctatcagcttaaggagattttgggctgagacgatggggttttctaaatatacaatcatgtcatctgcaaacagggacaatttgacttcctcttttcctaattgaataccctttatttccttctcctgcctgaatggcgatcattaaaaagtcaggaaacaacaggtgctggagaggatgtggagaaataggaacacttttacactgttggtgggactgtaaactagttcaacccttgtggaagtcactgtggtgattcctcagggatctagaactagaaataccatttgacccagccatcccattactgggtatatacccaaaggattataaatcatgctgctataaagacacatgcacacgtatgtttattgcagcactattcacaatagcaaggacttggaaccaacccaaatgtccaacaatgagagactgggttaagaaaatgtggcgcatatacaccatggaatgctatgcagccataaaacaggatgagttcatgtcctttgtagggacatggatgaagctggaaaccatcattctcagcaaactattgcaaggacaaaaaaccagacaccacatgttctcactcataggtaggaattgaacagtgagaacacatggacacaggaaggggaacatcacacaccggagcctgttgtggggtgggggcaggggggagggatagcattaggagatatacctaatgttaaatgacgagttaatgggtgcagcacaccaatgtggcacatgtatacatatgtaactaacctgcacgttgtgcacatgtaccctaaaacttgaagtataataataataataataataataaaaagattctatagttctccagcagtcgggttctagagtaatctgcccatgttgcctacatcagaaccatttaaaaactacaagaaaacatgaataagggtgtcacagcattgatagttctgatgagcacttttaaactttctattattaataataatagtaaataaagaaggtaaagaggtagacatcaaaatgacaacccatagaatggaaaaaaatatttacaaaccatataagagagtcatatccagaatatataaagaattcttacaagtcaataatgaaaaaagaaatgaggcaatttaaaaatgagcaaaagatctctaaagaaaacacacaaatgaccaataagagcatgagaagaggttcaatatcattagtcatcagagcaatgcaaatctaaaccaagaagagatactatgtcacacataggaggatggctataataaaaaataaagacaataccaagtattttgagaaactaaaacacttatacattgcttgtgaaaatgtacaatagtgtagtcactgtggaaaagtttgtcattgcctcacaagcaaaaagttaaacatagtttctatattgcccagcaattccattcataggtatatacccaattgaaaatctatgtccacacaaaaacttgtactcaagtgttcattgtagcttattcataataacaaagaagtggaaatccacaaaatatctatacaatgaaatatcgttcagccataaaaaggaatgaagtactataacagggataaacctagaaaacattatgctaagtgaaagaaaccacacacataaggccacataattgtttgattccatttatatgaaatgccaaagatagccaaatccatagaaatagaaagtagattattggttgccactgttggggagagggaaataggtgtgactgtcaatgagtacagggtttctttttgtggtgatgggaatgttttggaattagtggtaatggttgcacagttctgggaatatactaaacaccactgaattgtacactttaaaagggtgaattttatgatatatgaattatatctcaataaagctgttaaaaaacaggaaaaatagccaacattgagcacttatgtgttgtaggcattgcacttggcagctttgtatgcatgatcatatttaatgttcacaacaattatatgtacatcggtactattatttcctccattttacagatgtgaaaattgaagcttaataatggtatctaagttacttagtaatttgcccaggtttccagagggtaaaactccaagaactagaattcagaatctaggtaaccatcttgaacttttaactactacatgcatttctgcctacattttttatgaaagcagaccatagcagaccatacaaagcacagcagaccatacaattcactcatttaaatgaactacccatttaatagtttttagtatgttcatagatactggcaaccatcaccacagtcagttttagagcattttaatagtcttactaacaaccttcacccagtaccctttaaatatcacctctctactccctcatccgcccagtactatgcaaccatcaatctgtctctatggtggtagattgatactgccacctatagccatttgcatcattgtatattctattcagattctgttagtcaatttagataagaccaaggaataatgagacaataggattccctttaaaaattgcttggaggccaggtgtgatggcctgtgcctgtagttacagctacttggaaggctgaggtagggaaaatcacttgagtccaggagttcgaggctgcagtgagctatggtcacacctatgaataaccactgcactccagtcagggaaacatagtgagaccccatctcaaaaaaaaaaaaaaaaaaaaaaaatgcttcgaaacagcatcatttaaacggactcctaaaggcaaaggggaaccattacaggtttagatttgccctgtttctggaattacctacattattttactgagaagctgagtctactcaagaaaaagaatatcttgattgcagaaagtatattttgcttttgggaaaaattgcagaaattgtcaggaaatttctttgcctttaaaattgggacagtgccctctagctaaatgattttgctaagtggctttgctagaaacctttcctgctcctcttgtcctgaagctactacttttcctcctgaccctcttgacttcaatttgagtgtatgtgttccagttaacaagtaatttaggggagtgtcaaaaggtaactagtgtcccctgggttacaattaacctaaaaattaaaaggtggagtttaaaattctcattaagtataacaaaaacataaaaaggaatttttggattggagttggatttagaaagtcacctttgaattaatgaaactgaccatacttgactatgcaccaaattacgtatttgagagaagatatatattctatagtttagtggcaattagtggctaatgcaaaatgagtagaaaaaatttctaggagccgtgttccatgatcccattcactcacagtgcacatactaatgtgctccagttttaattacctctaatttctgaaatatgcttgtgagtgttacattatttgaattaagaattaatgcgttctcacttaacctggccagatatttggtgccatcatatatccctgagaaattttcttgatgatttatttttaaaggtagcataataaaaacagctggggtctctaaaaatgatttatagtaaactcttatagcctagtagtaaattctaactaatatgttttactcataatggatgcctacagcttgtcaactctgtgctaacaggggaaacaatattgttattgctcgtactgtataagcttcaaacacttatgttgtgctggataagctcaaaccatgttggatgcttaaaatatttaataactcatatacgctaatgtttattttacataattccaaaaactgtttctaaaagcaacaaggttcttattctaaaatagagtgtagaatcacattttatcgaagtcagtttgtggcctctcgaagcagaaatatatgcataaaataaacatctactaaacaggaaactttggggaggaattaaaatctatcactgcttttaaagaatattcagatgtgtataccctccttttgagtatttctattaaatggtgcttgggcagtaataagcctcatttacttatttaaatgtattctccttaccccaacccccaaaacacacacacacacacacacacacacacacgcatgcacacacacacacacatgcacacacacacacataattgtatgagtaaatctgctatcagttcttttgtctcaattttctgagttgtctggctttttgggaagttagttcatttgggggcatgaaaaggttagaagtgaaatgaagatgtcctcactgacccacattcggcaggacatgtcccttgagttgtttagaaatttagatggccttgccagttcgtttttgacctgtggcacacatttctatagcagctggttgcagttaggttttcttctgtatccgtgtagcagagaaaacatcattggcccatttgaggatggaacttcaaccttggtctcattagtgcttggctttagccacctgatacgggattacatagaagacggtaagcagcaaaagacaaataggaattttacagccattgacaaagaagacatagtaggtatctaggacttttctccccactagaaatgcttgggaaggttcacatactttctttggcaagccatctaagatatctcatgtctaaggttaccactgtattcaaacaggctgcaggttttttgactaaagtcaaggaaatatttttagttggtaagcagccttgattctttataaaatacatacatatggataaaaataacaccttttaatagggtaatatatttgtatgtagtcccttcatccttcaatacatatgtaaaaagtgaacagatttggttatttagtagacctcctctcaacttggtttataccaccagaaattgattggaaatgtttaaatatttttttgtttctgtttttaaatattactctttcaatattttgcttttcccaaactacctccaaataaggagtgcaaatgtagaaactggttgctcttcttcaagagaaaaaaaagagaatatgtttctagtgtttgtagatgaaaaagtggtgtactgaagtgtatgtagggggccttttaattgaaattaaattaaaattaattgatgaaagtgtttttggcttaaactgaatgagtcactgatgtactttaaacccttgcaataaatgaagtatttgctggtagaagagaatctggggctgactggtgacgattattcactgtcttaattgttggaaatagattattttctacctgcactgaagtcacaatgatgggcagaatttccatgggaagtgttatgcctaactggcatagtaattaaaatgtgggttttctgaatcctgaatgtagatttcacaattttcctggaatttaatatagatcgtctatagccacaggtagtaaagtgttaaacagtaaaggaaaaacaaataaacatgtttccatcttccctaatacataaatgcacaggaatggactgtatcttaatctagaatctagtttgctttcaaccagtaataaaagcagagaccactatatatagcttttggaattaaatagaatatatcattagtttaaggtatatttcaggaagaagaactaaccattagaaaacaaaccacaaatggaatactaacgctatggagcctgattcacccctcctttcctgatatggtttgactctatgtccccacccaagtctcatctcaatggtaatccccacgtgtcaagagacagacctgtgactggatcatgggggctgtttcccccatactgttctcatgatagtgagtgagttctcacaagatctgatggttttataagtgtttgacagtttttttctacatacacttgctctcttgcctggcaccaggtaagacaggactgcttccctttccgctgtgattgtaagtctcgtgaggcctctcaagccatgtggaactgtgagtcatacctctttcctttataaatttctcagtcccaggcagttcttcatagcagtatgagaatggattaatacccttcctgagagatcttagtgcagttgcaccctctctgccccgtgctcaggcataattccaaatatttattgttgagataattgaaaatgtaattgttgtatgttctaacaaatttgaaatttttcctcaggatggaagatttggtagtatgtttgctttccattctttcagatggttcatttgtcattcatagagtatccttgtataaggacttggatttaatagacgtgtgaaagttttcaaggttgacaatatgccacaacctggaatttatagtctctgttgtggttattgataatactcaggcttacgaaattcatttattttttattattattttttaattttttggagccaaggtctcaatctgtcgcccagactggagtgcagtgatgtgatcgtagctcattgcagccttgacctcctaagctcaagtgaccttaccacttcagcttcccaagtagctagagcaacaggtgtgtgccacgataccaggctaatttttaaaaattttttgtagagatggggtctcactgtgttgcccaggctagtctcaaattcctggacccaagagatccttccacctcagccttgcaaagtgctgggattataggtgtaagccaccacacccagcccatttctattttaattaggatctactgaggaagattccacagaatgtgatgattttataattgttaatattcttttttttttattttttttttatttttttttatttttaatcttttttttttcctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatgtccagtgatggtgagcattttttcatgtgttttttggctgcataaatgtcttcttttgagaagtgtctgttcatgtccttcgcccactttttgatgggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggtttattcttataatttgtgagatacctattcatttctaaagatcaaggtcaaattagcctgttcctaaactttctacctagagttgatttccttgcaagtaaatgcaattaacttgcatagtgtactaaccagccagttgtcaaactctaggcctgaatctgacttttggcacctatcatccatccagatattgtaaaaattttagcatctagtcaaacccttgaactttgtcagctgatactgtctatgccttgcctaataatattctctacttcttttaacaggctcacttaatatatattacaaaagaggaaggatttcacatgaatgtcctactcttttaatatgtgaatatttttctctttttttcctctccaaactgctcccacctactgcactctggtggctgaaattccttctatagagttaaggcatttttgttcaaagaggtccatgctaaaataaaattacctgtattgacatatttttgcctgattagtttatccaggtcattttcagatttctcatttgagagctatcttaaggggaagataagttttggtgttgctcaggagtgggagacaaaggcatgtctcaagattgtgttcttgacaattctgctattaaatcagaatattgtgtgaaattacaggtgttacctactaagataagtaaggggagagacatagaaatagggaaagaggacttaaaaaggaaaaatagctcttcaaagaccaaagttacctactttactgttcttcacaagcctgattcaaacctctagaagtaactcagctcatttctggtgttcacttcaaggtatattgctgcttttaaacttaaactttgtctaattctgtgatgaaaagaaatgaatgaacaacctcaactttcaagcagttttttctctaagagcactgaagtcatacttaaagctgttgaataaaaagtgccattaattgaagtatacgatatattcagatatgagaggttttattattcactgaaaagtacaatgaatactatattctttaaaagtcattaaagcacacatattctacttgactgctgtatttatataagcattgctagcatttgccctttttatgtcttcttcaatttttttctcctactcttcctcctctttatctttcttactgtttatccatgccttcttcagctatcctcaacatcactaagctaagggaatatataatcttatgagatgtactattaagtggtaccatttgagagtgtgtctctccctctgtcctgtaatgtgcctgaaattctcagaattttggttatggtttgtgattagggcactagccccaaaacatcataaaaatcataatgcaaatgtccaaagcaagtacactcacatttattccttagaaagcagagagaagattaaatgatccattttttaagacttgtgtaacctagcatgttagagttagaaaggatctttgaggtcatgaacagtttttaattaaagttggcttgttttatttccttttcatttgtgtcagtcctttctttagatgatatttaaagataatgaaagttcaatgaggaaaatagatgaattaggagaacattaggactcacctctgctcgttactggttctgtggaagcttaggggttctgtgcagtgaaaaattgagctcatagttctggagcctttttttgtggagaaagtgtgaccagaagttcaatattctgattcccaatccagggatctttgtatccattggattgctccctataattacctttttgtgtgaatgccttatctgaatttctactactttgtagacatatttttgttaacatgcctacacaacaatactatggatgttctaaatagtgaaatgacaaccatagaaaaataatccaaatgggaagagggaaaagtgattctgaaatagaaccgtctctggcaagacatacaatttctaagagaacctttgaaatatagctgagtatgaaaattgggtagggatgtcgcattattggtaattcttattgttttaatgattccccaattgacattaaaacaatagacaagttaagtgatctttaatagaaaagagaatgagttgtagatcaggttcttccaactccagaagattactttctgaaaacaaatagcaatatctggtgaaaacaagtttactgaggtcatgagcctaaattttattgcaaaggtcgaaaagatgaatagtatcaatttttttttccttcagctcagacttttaacatcagaggaaaggatgttatatattgcaaaatagatgtaatcactgaatccaaagagaaatgttattgtgcactgaaacactggatccaaatggaatctaattaatcaaagtatgttttgctaattaggaggacagttgatgatataacatacatctagtgatgttttaaaatatcataactgatgagagttgcccatattaagcatttgaatgggtttttgaaatagatggagtttttcaatttcccagtttgtagaaactgcaatcttagttttagagatgtgttaattatgaggcagaaaaataaatatcatataatgacattttatggtccaaacttccatagagtttcagttatttgatttttgttgtcctaagtttctacagcttttccttcagaaaatgttctatttctggatgatatgcagacaggtaaatatccaggttttgtggggacctgaggtttatgcactttgggggcccctctttttaaacagaatacaagatcgcaaatgcaaaattaggaatgaatgtgaatatttaggaggggcctatgcaagggaggtgccctgaggtttaagctttacggtaaatccactcctgcatgcagcacatactagtaaataatttaatagttgatcagtgaagaagagagaaatttttcaaaaactacaaccctttgattttggaagtcttttgatatgttaataacattcaaaaatacaaatgaaaaaattgtaatcagttggtcaaagacagaattataatgcacagtttgataagatgagatctaaattagatcaattaaactttgatagtgcagtgacaatctggtatttctttatgtaatgcatcttgagaaatgtagttacaattattttaaatcactgatagtacattttataccagttaaatgggaattaccaagaaatacattcaatctgatcaaggttaataagaaaaggctcagtgttttcagagaatacccttttgaacagacggtcttctgtaacatgtgaaaagaaaactaggatcaaagtaatgatttagttttaatttgtgacataaactgcaatttaatctaaaatcactatacttttaggcatctgattctgttttctgggttggtcactaaataacagcatccagttatcttcagttgcaataagaacctttgtgcacacactttttatctattaggttcaggtttacctatgtcttttttttaattcattagaagcttaattaaagatatatctgtatcattactagcaagacaattagaatatatactaactaatggtggctgaacaaaattgactcatgctttgggggccacctgtagagattagggaagcatttgactcccctggtggttccatttgatgtataccacagatacttgctaatgagtagttcctcctttgtcgtgcactggtgtctgaaaattcccaccatttgggttatggtttatttttaaaacgctaactgaaaaacacaaatcatcgtaaaaattaaacctgcgggaagacaaaaaccttatctgatattgatttgtgccaaatataaaactgataagagcttggctataaatccagctaaaggtgtacagtcaagagcaagataatgggtgctatttggatgtattcataggtaaacaactagaatttaaagatagagatgtgataaattagctcattgggaaagagtagaaccttggttatacttcttcctgacttgattattagttaactgtgtgactttcagaaagtcgcttgaattctatgagttgtccctttctgtatacatgaagaagtcagtccctttcagtggcagaagtctatttatttaaatacatgttgggcatcaaatattctttaagcctagtcttttggaatattaaacaatagttctttaaacttaagtctgtaagccaattgccactggcggtcctagcagtcagcatttgctgatgtactactaaattcatattcacttcctttttttccaatattcacttttggtataaaggtctaggtcaattatagttgttttgtgagatgaaaaataaattgaaaaatgacagatttataggccaacttacaattttaatttgaaaattgcctactgtagacataggcatgtcatattcaaaacagatttgagtgtccattagaccatagtgtctattaaatctactcctgttcggtcctcagagaaaattatagtaaaagtcatagcttacatagaggattatgccgtgtgtctatagtagctttcataaccaataaggtggttttataaagcaaaatatatatagcactgtttcgagtgctttaatatattagctaatttgatctttagactatatcaatgaggtttggcattattattattcctatttttcagatgatgaaattgagacacagacaggctaagtaacctgaccgacgtcacagaactcaaagtagcagatgggagagttggtgtcactctccagagtcatactgaatagagtaggtatggtaaggaaaacaaaacaaaaaaaaggctaaactgtgaaagggcaagaaacatctctacaagtagctgagcaaagctatctcacacctagaaaaatatatcctaaaacatatatagtgatgagaagctacttatagcaatgatctactggagtgcctggaatgagataaagagaaaatgtgagacaagcagggctaagtaaatgtgaaaaacaggactgtgaggctctgttattttactgacagtcttgctgccttggaataatgattacagcctttgcagaagtcacctgtgaatgtggagttccatatgcagatgtgaaacagataaagttctttcccacttgattctgttgacatggcatgtggaaaacaaggcaccatatgacaaaagcctaggaaaactagggaagtgtggtgcacggtactgagagcattccaagagcctagagagactaatttatgaggaaagattaaaaggattaattgtatacaacttggctaagtaatgcctaatgaggaacatgagaactgtctgtaagtatttgaagaacaaatatgccagggagagaagggatttacctagtgggacacaaatagatgaaactggaaacattggttgtaatttcggacaggatcgttttggcacaatagcttataaaacttgttgacagttcatatctattataccgtaaaatagtttcagaaaataaaacaaaacaagggcccagtatggcctttaagaatatcagcagggtgaacgggaaggtacagtgatgtatattgagtagataaagtataggttaaatattctggttctagagtgtaatatcccttacagttattaaggtctctgcccatcctgccccataacaatgttatagtgcaagttaaggttattatgttttgcatcttactaccccgtggtatgttgagtagttctgtgtctggttctctggatagatgttgctacaggaaaatagagggcaccaatgagaatcaaaacctgttctccagatgggggaagcattatttcaagcagagaccagatgctggaacccaggagattagagattgcaaattagggattttatttaacatagtaggtgttcacttattatctataggatgaataaaggaataaaggaacgaataaatgaatctcattgaatcaaaatatcctcatctgtaaaatatagttagcaaaaatacatatccataactaaatattttaaattaactaatgtatgtgaagccccacaaaaggtatatgttcaataaatggtagctattattatgtgttgctcattggactagcacagaatgatgtttaagctcttcctttgactacttcctgcctttgcacccttgattatgcctacttcatcaggaaggtgttgactggaatcataatacttaaactctttgggagaagtcaagagtccagagtgagccactactgaagcagtcacttttgtattcaaattaagtcattttgcacacagtggaagcctgatggtaccgctgaaaagaaaaataaattagcatgcttcacagcattgatctggtagaagaagtaaagactattttatgtcataggttgccaaagaggtttcctatctttttaattctctgtaagtagaaatcacccatgttagtaaagcatcaagtcccagttggcctttgcaatattcttatagatgatccaagttttggtgggtattacaatgcatctgaatacaaatagattttgccttaaactctgcccaacactattaaagccaaactctacacagtctttgtctttatgtctcccctttacaattcttggtacattttgacactttaactcacaagcatttcaaacgtaagtgtgttgttaattctcggctgttaaaaatcaacacaaatacgttgcaaagccacgatgctttatttagggtgaaaaataattcttttaaaagatacagtgcttgagctttcaacaaatacttccttaaaatgaatataacaaaagcaacaacaggcataaattacattcaaagagaaatcaggtagaaatagaaaattttgacgaagtgccaactgccacataatgttgcaatgacttaaagaatacatttacatttatttagggaagattaaaggcatctctgtttgtgaaatgtcaattaataaggacctgcagtttttgttagtgagagcgtgcattttaattgcttctgtggaattttaataatgattcaattgtccttataaccagattactaaccctcagtctccagagtagcctgagagataacacatagcagagttcccataatattttttatcagcttgttgagagtgacatgctattgtttctgatggagcatcacaataggacagcacaccttctccattcacaagggataggccctgagacctttttgactccccacagcctcaaatatcactctagcatataatttccctcataaaaggcagtaaagtataactgaaaaatttaacagacccttttcagaccattaatggttctataaatacaagactaaagtcatttacaaagccattttctggctaagaactagcacttccttttcactgctagcattatcactagcagttgtgtttttcttttcagggccattttttcacatagaattaaagttaattgtcatcacttcagtagagttgctgcatatacccccaacaagtatagaagagcagagttttggatgttgggcagttggccaactcactcactagttatattcaacaccaaagatccaaatttaggtgtcagcaacattacacgtaactacaggtcatggactcatggagtcacttcctgaatagtcaaaattgcaaatgttaaatccataaattccaatgatctgctgtatttactagcttaataagcttggcagttgcttttctctggttgttatagcagagtatcaactgcatttgagtcataatggactcttggtgctcttatcaactctacaaaaaatctgggaaatacatttaaaattataggacttgaagaccagcactggcctttatgctatccatactcacttcccgatacttccaaatataggtataccatttctagtaaattccatttattttactattaagaaatcagagagcattctatttatctggaaaatagaagccaaatagcagtatgtataagcattaaccacctcctatatccaaacactgtgcttgtcactatagtgaatgaaaatatttaaaacttccatttgttagttatttagtatattttgggcattgagtaatcactttacatgcattatatcattacatctaatggtgggcctataagaaattctccttgcccgtaaacaggctatagtctatttgaagtgatgtcataaaggttagatttagttggttccctaggatggcctgagaggcataggaggttttacccaaaaatgtactagacatccaatatctagttttctgagtcaactgcattttcctttttccacaaagtgaattagaatttctattaattctggtttctggtggatatctctgaagttaacatttgtatatttaatttttaaggattgataaatgtatcaaaactaagatgtgagtgaaaatttaatcttctttagatcaatctactttttgtgatttttattcaaaagcattatattgcatgtaacaggatctttcttgtctgttagagaagatcctacatccctgttggactgttgttagtttgcgagtttgctgtaagcctcccagtgatctttgatcaaaatttttattatttcccctggtacttaaaggcacaggtcccaaacttgtacctttatagcaaggtaacttactgagcaagaatttgtcgggcagtggagattaatgctaacttttgcaaatggcaatttttggtccccacttcctctggtatatagttaattaagagcagtgtaacatagaaaattctgcaaaaccaaacagattgctcaagtctagcatcttggatggtatgtagatttgttgcttttcctgaatgagtattcctgtctgtgaagcaacaatggtagtctcctgagtaatacattgcctagggagtcaagagctcttgcttctagtccaggccttgacacagactctgagacttctggcaagttgctttatttctctgggccatggtttctacagctataaaatgggatgatgctgtctgtctcacagtgttgttgtaagggcaaatgcaaaaaggttatgttgccttagaagaaaggcaaaatagacatccaaagtggtattcttagataagcatgtatgtatttttctgttgtttacatgtgtaataaaaatatgtcatgttattttatttaactgttgcagcccaaaaagaggtacagatgaataacatttggttataaacaaaaaaatgaatattgtgtagatgagcaaagtaaatttttcttctgccatgtatgcaagttgtgattgttgcagtcaggaagaggatgtggaaaaaaaaaaaagcaaatctgcagctattcagctcccatctgtatacggtaaaatgttccatatcaaaacggtaaaatgttccatagcaaactcatggttcaaaagaaggaactgtagcttctcacactttgccaaccctttgtccttcccttcctcctgctacttactgtaagaggctgctttttctactctcaacttcacagtcacccctcaagaggtttagcaggctgtatcgtcacagctttgtcttctttatcaatttcaaaatacaatgaggataacatgattatctgtagaactgtttctctacatagtactcattgagtttttggggtttttttcatatgggtcaagtcagtaagtctttacctagtatctgtcatgtgtccagcctagtacaagacaccatgaggaattcatggaaaataaccaacacagtcctgacacaaaatagtttacatgttgagataaaacattttcatatatgatactcatctcatcttccttttgaactcaaaacttacatctttgagactgtgagccatgtctaattcatcttggggtcttccacactcacactttgagatggagaattcttcatattatgggagtggcccaccccattgtgttatcgttattatctttttcccctatacaataaatgtcagtagcatctcccagtcactgtaacaaccgaagttacctccacacctttccaaatttgggataagtgctccctcaattgagagtcactgttttacagcatcatggatgtcagtttgcacatgatagacaaccctccatcaatattttctgaaagaatgaattcatgcaacatgacaatgggagaataattaagcagagcaaaaatcacatgcaagaatccttgggacagaatactagtacattagggctctgggacgtgaggctgtgttgtgctgggctgtataatttattgtattgggatgtgcttaaaggataaataggtttaccaaagtaaatgggagagtggcagcccctgtaaataagggcagcaaaattaaataataaaacactgtttggaggaaaccttgctgactggtttggaaaactgtctgggggatagtacaagggatgtttgaataggtagtagtaagcaagactgtagacagctgaacttgatcctataatcaacagtttacttccaaaggcttttgtataaggttataacatcatggaagtcttaagacgaatttggctattgaatataagatgaatttggctggacacggtggctcactcctgtaatcccagcacttttggaggccgaggcggatggatcacctaaggtcaggagttcaagaccagcctgaccaacatagtaaaaccccgtctctactaaaaatacaaaaattagccgggtgtggtggctcatgcctgtattcccagctactcagaaggctgagataggagaatagcttgaactcaggaggcagaggttgcagtgagctgaggtcgcaccattgcactccagcctgggcaacaagagcaaaacttcgtctcaaaaaaaaaaaaatgatttaaaaaggaacatactggagactggtgactagttaggaagttgttaccataatctagctggaaaataatactctgtcttgctcactctaccaccccgcctcccaccatctcaatctcttgtttgttctctcatccacatattttcttttattgtttcttcatctcttttaggtagtggaatattttttgatacctaaactcattaatgttttctttcacttctccttgcccttctagtaccaatggaacacattctattacttttataatttttaaaaatctgcttagttttgtcttctaacccttagttcacagtttaaaatttttgaagtactagaagttggaaagtaaaatgaactcagaaattaatgtgatctgctcctaggagaagtaggaaaataagaagaaacacttaattctaaagatagaggttctgaatcatgaatggatgaagttcacagaggagcaatgccatctcgtttctgaaaacaacctgatgatgaattaggctatattaactcaatataatctgacctaaaagaattctttgtaaatacctaggtgatgagatgatctctgcagcaaaccaccatggcacacatttacctatgtaacgaatctgcacatctgcacatgtaccctataacttaaaatacaaatgaaaattaaaaaagaattctttgtagattattttattcagttaccaatcttttacatttcagttgaggggacttagaagagggaaagatgtatgtccttacttctcagatcaattgccatttacttaagataaccagaaaagaaacaatataattaatatagcaatataaatggcaacaactccttaatttatattaatttataataagattcaaattataaaaaagaatgaaattatatcctttgcagcaaaggaggccattatcccaggtgaattaatggaggaacagaaaaccaagtaccacatcttctcacttataagtggagctaaacatcagatactcagggacataaagatgagaacaatggacactggggactacttagagtggggagggaggaggggaagagttaaaaaactgttagctgctctgcccagtacctggatagcaggatcagtcataccccaaacctcagctttatgcaatatacctaggtaacaaaccagcacatgtacctgctgaatctaaaataaaagtagaaaaagaaaaaaattaaaattaatatactaatgcaagatttctaggttggttatttaaacgtttataggaatatatatccaaaacatattttattcaggcatccatttatatacaatcaatatattagattctaattattcttatctactcattaagtgtcctaagggaccactactagtaacacttaacagcaagaaacattgtgaattaaactaatgcaactgttgcattaattaaactattttaacatttagacattttgtttttaataattcacatttttttcacactactaaaatgttattctctatataatatgtgttaacagataacattaagcagaaaaactgttagactatttaggtaaagataagtaaacttttcacatctgtcatacacagtttgaaaaagcattctggggaaaagaagggataagcttgaacatttttcatgaacatgtagttaacaaactatagaatataaaatcctgaatgatatagaaagccattttggtagtttacacctagaaaaaaatgtaatgtctttttgtcttggcagttaaattcattttgatatatttttgagctgattgtttttggtaggccaactaaagaacagagtaaacaaatttatggagcacagaaaacaatgtggtaaagaatgagagatgtattttcccatgaaagtccatttgagactcatgggttcctaaacgccgaccttcttcggatgttttaggatttaagtttgagaatgtctagccaattgcgattctgtgctttgaaggaagtaataagacttcatactgcctgtgaactctcaaaacattaatttgattaaccaattgatatgccacataaatatatttaaaatgccttaaaatacacattagctaaaaagtaacagataaacagatatactgtagatggtcacttaccaacttcaatcactttgaaaatacaaatgacacagatctaatttgcaggcaaatctctttcttttagttgtgccggtaaataggttaggattatgatcttcaatcctgttccaaatatctaccatatccaaagtttccctacttggtagctttggtcctaaattgtgatcagtgccctaccctggtgaactggattgggccacgtgtcaactgccagaaggctttttgcataggccataggcaggctacagctatatacacaaccgccagtctcctcttggccttctaaatgatgcctgtggtgaactttggcctgtgtttcctatggggagactactggttctctgtactgtactggctgtgtgcattccaggaaataaaaatagcagggcagtgtataatatagttttgaggtttactaagtaatacttcgcacaggagaaataatatggattttgtaatctgaccaacctaaattggaaacccaaatttgacaaatatgagctgtgttgtgtgacctcaggcacattgctgcaccactttgagtctcggtttcccgcctgtaaaatggccaaaagtatgcctacaaccctgctaggatgttttgcttttaaagtgctacaagagatgcgaagagatgggatatcttcctctggagattggaaagagttgatgtaatacagacctggttccaagatagggaaatttggcagctcttgttgagatgtagcctgaggataaattagaactattctaaacaagtggtttttaaataaatttaaggaaaatcaaataggacatagatcaggatataagtaagacttcaatggacttgagccagagagctctccagaagaagagtgaaagaacttcctgtaaggtcagtgtcagccatcctcaaggccaacccaagccaactgccatcactactcaatgtgcatttttaatgctatgctagttcctaaactgaagaaaaatttcagtaacattgaatgaaatattttctgtgttcctctaaatattatttttattaatgatgaaatatgtcaaatgcacaggatttcacatagcaaattctcgcatacctatcattctttcactaagttatgtcaaatctagcatgttaccttttctttaaatctattttcaagaataaaacgttacagacaaagctgaaacttcttatgtcccccccatgccattcttccctctttcaccctagatgtaagcaatatcctgaatttgatatttttctttgttttttattggttgcagacttttaataagttaactattattcctgttttcattgtgaacatttctgatatatgaatattttttttaacttttattgtaagttcaaaggtgcatgtgcaggtttgttacataggtaaagttgtgtcattggggtttgttgtacaaattatttcatcacccaaatattaagcccagtacccattatttttcttgatcctcttccttcttccaccctccactctctgataggccccagtgtatgttgttcccctctatatgtccatgtgttctcatcatttaactcccacttataagaaagaacatgtagtttttggttttctgttcctgcattagtttgcgaaggataattttcatttctatgtatgttttactgtttttacagcatccatataggttttcattaaacacatattcttcttcaatgttcttttgtctcttaactttatttctgtgatttaactatgctaatgggaggctctatttcattctgttaatatataaaatgaatctattggatgaaaatacaaatcttccattattggtggatatttagacttttcccagaatttaattttacaaacagtgcagcagtaaatattcttatgagtatttgtgtgtgagagagagttttttaaagtatacatctagaagtggaatttctgggtcgaagagcatgaatatcctcaactttactaggtattaccaaattgtttttcaaggcacacaaaattagacttctactagcagtatgtgaaattcctaattctctatatccgtatcgacatttagtgtggttaaatttttgccagtctgcacaatgctataggtccacactgatttaatttatattccactgattgcttgtgaggtaaagtactttttcacatgtctatcgtcaattcagattttcttgtctgagaattccctgtccatataatgtatttattttgctactttttagtcataagagtcttcttaaaaataatctttgccacctgtagttccagctactcaggaagctgaggcaggagaatcacttgaacccgggaagcggaggttgcagtgagccgagatcgcaccactgcactccagcctggcgccagagcgagactccgtctcaaaaaaaaaaaaaaaaaaaaagaaaaagaaaaagaaatctttgtcagttatggttatgatcctcataattatcttctccaaacttttgacttgggctttcagtttgtttcttatgcctttggcattgcatcaaatttacagattaatttgaatacaattcatattttcatgaagttcagtcttctaattcatgaacatactttatctctcctttcgttcaaatctttaatgtccttcaataacttttgctcactccataaaggtttcttgcagcttttactagatttattaggttctgtttcagccttcgttaatactgtaaatggaaccttgctttttttttcttattgaattctctaatttgttattactcatatagaagtttgttattggttttagtacattgattttctttccagaaaccttgctaaacattttgttagttcaaataatttgtactcacttggatttttctgtgtagacagttatatcctttgcaaatagtgacagttttgtctaatgctttccattttatatctgatttgttttccttgttttattgcattgtcttggaccttcattaaaatcttaaatagaaatgatgaaagtgggtgtttttgtcttgattttaatgggaagacttccaaaattacaccattgattattatgtttactgcaggtttttaatagataccctttaagaagttgagggactactgctatatttccaatttgctatgttttctaaaaaaggtttttaagtgtgatgaatttacttcatcacatttaaatgaacttcactgaagttgatttttgttaaatgctatttcttcatccattcaaatgacatatgttttcgcttttgttattttgttaattaagttaattacattaattaatttatttaattttgaagcagcctttcattttttggataaactcaacttggcctggatgtattatattttttacacattgctggatatggttcagtaatttcttttaaggatttttgcataaaattagtctgtaattatccttttccaaattgcccttgtcagatttttgtatcgtagttacacaagcctcagtgaatgagcggatagctttccttcttttttagcctctgaaatagtttatatagacaggggtttatttctcaaaaatctgataaatgttgcatttaaaattgtctgagctggtgagtgggagacttttgattatacatttcatttgtttaatggcaattgtttatttttcattctttaattttttccttggagtatgttagtgatttatatttctctagaaaattattccttttatctagtttttcaaatgcatttgcatgctattgtttatggtcttattttatgattttatcatttttgttgtatctttattttctcttgagtattagggttttttttttcctttgccttttctccttctttatttattggttttactggaggattgtttattttacaagcattttaaataaaccagatttttgttttatttttgctggttgtgctttcttttttctattgcactagtttctgtacttattttttactttttccttttcttttattcacatttagtctgatgttattttttccaactttttgagataaatatttaactcacttatctttccatctttaatgaataaaggcatttagtgttatacatttccctcattgtatacctttaggcatatcccacaaatgttggtatgtagtacttttgcaacctttacattctaattttttttaaattcccattgcaatttaattgttaacttatcaggtatttagcggtgctttaaaagttattatacaaggggtttgggactatcattttagtgttgatttcttagtgctcataattgtgttttaggtctcttaccaagagcttatgcctggttctcttttcttccccggtcactaatttcttacaaatctgtaaccttttttcagaaggcccaacatcaggactttgtattattcaccttgcctgcttcccagcacttttatcatggacacacctctggagctgacgtgggtaacaccgcatgcttctgaactcagaacccagcatgccatttgcttcactgcttcagctgcttcagactcttttctgtttctattctaaaaagatgttaaatcttgtctttgaaccgagctatattttttgctcttctccttttatacactatctttcatttctttgtatttagagtagaagaatgagttaatttgaatttctgtgtctcatagttttaaaacatgtacttctctgtgaagaggaagaactggagtagcaccctcacttcccagccaaaccgcacccccaccccagaaaaacacaatagtatgtatacatacatggtctcaattaatcctttattttgactacacaccctctttatgcaatattgaaaattcctctttgttttatggtcacacagtataatacttacaggaacattgccctctgtttttggacccttcagaggtgattattcccaaagaaaatgaatactacttttgccttgtattcgatattttcaatattactttttaaaatttcaattttccagtataaaactgaaggtcacactgcctgttgataactagcttgttcaagtaacagtgaaccataaggccaacagaattgattggaaattggcggcctctctgcattctaagcacttatccagagatttagtgagagctaatcacttcactgaaaaaacagataaaaatataaagatccgctttacattcagtaaagcatattgatagtaattagatgagaataataaagctaactaactgcattattctaagcatatcttattttattttatttttaaagatttgggaggtctaaatacagttctgttacatggataatattgtttaatggtaaagtctgggattttagtgtacacatcacctgaatagtgtacactgtacccaataggtagtatttgatgccttatccccttcccactatcccacattttggagtctccagcctttattattccacagtgtatgtccatgtgtattcattgtttagttcccacttataagtgagaatgtgtggtttttgactttctgtttctgaataatttcacttaagataatggcatccagttccgtccatgttgctgcaaattcactttttttatggctgagtagtgtttcagtaggggtgtgtgtgtgtgtgtgtggtgtgtgtgtgtgtgtgtgcatatgtatgtgtgtatatatatatatccagtcatccattgatggacacttaggttgattccatgactttgctattgtgaatagtgctgtgataaacatatgagtacaggtgtctttttgatataatgatattttttcctttgggtagatgtgcagtggtgggttgcttgattgaatggtagttacatgagaaatctccatactgttttccatagtggcagtactaatttatattcccacccacagtgtataagcattgccttttcttcacatctatgccaacatctattgttttttaactttttaataatggccattctggctggtgtaaagtgatattttattgtggtttaaatttacatttctgatgattaatgatgttgagcatttttttgtctgtttgttggccacatatacatcttcttttgaaaaatatctgttcatatcctttgcccactttttattggggttattttttttcttgttgagttgtttgtgttccttgtagatactggatattagccatttgttggatgcattgttcgcaaatattttcccctgtcctgtaggatgttaagaatattttaatggatagtaagagtctaggtcttagcctcagggaggcattgaagacttgtgtctcctctactagtgaccatgactgagagtagtggttacatgctttatactgaaccattcctgagtattctttccaccatggtcctgtccacagaagttttttttttttaagattcttctgtccttattcatgagtgcataaggagctcagtaaaattctctgcatgtcatcatctgtcatcatccaatgttactcttctgtagcattgtccttgttctctccagaatcttatctacctggttgacgcagagccataagatcttggctagtgtattagtccattctcacactgctataaagacttgagactgtgtaatttataaaggaaaaagttgtaattgacttacagttctgcatgactggggaggcctcacgaaacttataatcatcgtggaaggtggaggagaagcaaaggcacgtctcacatggcagcaggcgagagtgagtgtgtcagtgcaggaaaaactaccatttataaaatcatcagatctcatgagaattcactcactatcacaaaaatagcatgggagaaaccgcccccataatccaatcacttcccaccaggtatctccacaacacctggggatttaaattaagatgagatttgggtgagaacacaaagcctaaccatttcagcttgtcatctaaatttgaagtcagcaggggtctatgctgaaaacttagccaaatggtgtactccacagccttatacttgtggttttcagaactgatgtggccaaagcttagtggatcaccttgtttctttaatcctgtacttccgtaacccattatgcagaatatgtgatttgtaataaatttatatttaaacagatgattactgaacataagaaaagagaaatgaaaaagggttatgaactaaagttgtattttgagggggtgcacagaaaatatatacacaactaatgtagccctaagtttatcaaatataaaatcaattgtgcaacagctcatacctcagggggaaatattgtcttttttagtaagaactgccttgttctaaattaattaggctcgatgatgcttgcttgggctgctaaacacaaatttttcaaagaaatcttgtagtcataagaatgctcttaaagtagttcattatatatcatatttgaggctggagcttttagaacaccagactattaaagtttctaaaaccaaggatcaaactctacttacagtaatgattttgctacttagcccccacatgataatgccatctgaacctctgaggagttaaccttaagctagatcatatattccatatattttggcctgaaagtttttatattgttttcaaacaaattttatcgaaccctggtgcttatattttctgcttcttcacacttctgcttatttctttttccccatttgtgttgggacactagctgaggtaaatatacaggacttaaatttgtaaagttcaggttatatttctcttaaaactttagtttccttgaaaaacctatgtggatctttcagctaatgagtgtaaagtcactaagctctaaagctatgtcattctccttgtggataaacttattatttgactagtataaatgaggcacatattaatgtttcaatattcaggggtacgcttgatattgaacacaaggagttagcaacattcatttctagccaaataggtactcaacaaatatttgctgaatgaatggattgtcataaattcttctaaaacttgataaaacttcttcaactttttagtaccatatttgtcatcaccagagggaaaaagggataataatttctgacacttaaaagtattatgggacaacttagggcaggggtcagtaagctgcatccctcagctaaatgcagcctgctgcctatttctgtatggtttgtgagctaacaattgtttttacctttttaaattgttaaaacaaaaaatcaaagaaggacagtattttgtgatatgtgaaaattatgtgaaattccaattttactgcccataaaaaagctttattgcaacacaaccacattcattcgttcatttacacactgcttttgaaacacaaagacagagctgtatagttacaacagaggccatatgaaccagaaagcctaaaacatttactctgtggctcttcacagaaaaaaaaaatgtttgccagatcctgacttaaaagattcatgacatggttttcataaagaaacctactaggggaaaaacagtgctatataagtacaaaagtgttacaactatttcatttctaaatatgttgctattatttctgagctatttgcttgtgggccttataatggtaacaggtgctaatgcgcaagaataggatggtaactcctaccataattgtccacattcatagaaaactgcaggtatagctgcagccagatgtttaaagaatggaaattgaaatgaaaatgtaaaatctttactgaaaaaagggtagaaatgacacaggaattgcaccaatgacctgttaagaagcataggcaaaaaaaaaaaaaaaattgtctttaattcatgtgtgtaatccctgggatggatttctaatagacagcctcgcaaaaagttcacataatttgacaagaccataaaacagtttctcttttaaggcaaaaaaaacctaatttctttaaaattttcatagcatcaaccagtattaacaactagtcatatagaaaatgttggcaatttatttacaattataaagctttagtgagatgcttatatacctatggggtaagtgtgtatgtagagtgttaaatcaatgttagaagagggaaacgagtgaaataccaaattttgaataatgtaagtaaaatcacacaattttaagactatatccattttagggctaaaagcttacaacataggctgtgttgaaacagcacaaatggaagtgaagtttaattaatggagttcatttaactaatgtagacaataaaaccagatatttcactgcctgaatgggattacattttggcagttatatagttaatttgattcattgggatttgtaaattggatcattcagagtccaaagtgaaatggtgatttaaatgcagcccaatggcctttagagaaataatcaattcttcagaattcctctgaagaattaagttttatcctaattactcacctggaaaattaactcgaattttgaagcatttggctaggcaaaaataataataataataaaaataaacctgggccttccatttagaaaaaaaaaacatccaggaaaaaaactttgggaaagtttgagcccattaacatcaggcctgaaccctggtttcttgattttaaaaagtatcctataattatataggttcatggagttagcggatccattcacttgtttatttagtaaatatttataaaatcctactattgaatacatgccaagtacttttgaagccactgggaatacagaggtgaacaagttaacaagaaaaataggttccctgtcttcttggagctcacattcttgtggagaaaaatagatgataattgtgatttaaaaaataatttcaggtaggaaaaaattctatgtgataaacagagtaattagagggagactgagatgaggagcactactcctgctagtgtggatggagaaggccttcctgaggaggtggcttttgagctgagacctgaatgatgagaaagatgaatgttggggagatcttagagaagacacattcaaatacataacattaactctaacgtggaggcagagtccatcctagagactatttcattatgctcaacatcaaaactcaacctatattttctgaccaatactcagaaacatctttgagggacaattatgccatggacttattactatcattatttttgttatattgtaattaatattataattatccattgaagttaagagatattttcacacatattccattttaatctcatggagtgtgggtatattaatatccctactttgtagaaaagaagacttggggttcagggagatcgagtaatttgctcaaggccgcccagagaacagtttagtaattgtagagatagggccttgaagccagactttttttctaaatatccaaatggctcattttattacactattctatcttaaaccatactgtaattataagataaggttctgaataataattaatatccacaacagacaacatatttgtgtctacaataaagtaagactctttaatatctgctactttaggaaaagtattcagaatagaatttttagtctcaactttcatgatgggttatgatcaaaatagaggatgtgattgatttcatatagtttcacacatgatattcatatttggtgcttaaatatttaattttgtacattaaattttaaatatttaattaaatttatatttaatttttgcttcctctttttaaagcaattcagatttgtaaataacattgctgctgacttgtttttagaagagctgtcctttgaaaagaaaattagtcataatgtaaaattgcaattagatgggggtttgtttggtttgctttttgttctgttttggttataagcttttccagcactgatgttaaaatgctcacctgtgctagcctggacttgtgggatattcattgactttatgtccatagtaaagtagtgcagatcatcttatgtgcaaaacacatttggctaaggttgacaggattttcattttccattcacagatgtaaaacattttcagtataacacaaacctcagcataacaaactcagcaatttatgagaagcacacagctctgcttacctttcatttgtcaaagattgatgagaaacatctatattacttgttcaatctgttaattatatgttttcatccaacctgaactgataagctaagatctgtccgctcatattagtctgtagggatatgcttgtcaataaggcctttaaacttccttacatgtgacctataactcaagtaattctttataaagcaatatttgaaaagttatctatactttaagattacacttacggtacccctagatgaaaaataaggtacaaacttcaaagactgcagtttcataatctctaaggtccataatttaattttagatgacttaatattaactttgaggaaggagttaggaaatttaaaaatattatgcttgcttttaattaatttttagcttttaattaatttttaagttactcaaattctacaaatattttggggaagtttgcataactaatatagtgagttttagagatttcctctccaagtaggacctcaaaaatgcttccaaaataaacattttaatgtcataaattttttaattcaacatagtataaaaaacataaaaatggagttgatggctcttggtctcagtgtggcaatgtaaccaaaaactaaacaaatgctctcaagccaaatcattatggtaaagtttaacatctgagctccatgaacctatttgttggatcatcaaacatatgttggaatgatcaaattcattgtcctagcactggtcataatctgaatatcttcagcacaattcactgccttgaatcattctggttttaagttaagcatagaaaacagatatcattaactttaaattatctgagttcttatggtttaaagcaaaactttgagttttctcttgactattttaaagttaactaatactgaatttgatccttgcttttttaaatttaatttttttattaaactttaacttctgtgatacatctgcagaaagtgcaggtttgttacataggtatacacgtgccacagtggtttgctgcacccatcaacccatcctctacattaggtatttctcctaatgctatcccttccctagcccccaacccctgataggctccggtgtgtgatgttcccctccctgtgtccatgtgttctcattgttcattttccacttatgagtaagaacatgcagtatttggttttctgttcctgtgttagtttgctgagaatgatggtttcagcttcatccatgtccctgcaaagacaagaattcatcctttttatggctgcctagtattccatggtgtagatgtgccacattttctttatccagtctatcattgatgggcatttgggttggttccaagtctttgctattgtgaacagtgctgcaataaacatacatgtgcatgtgtcattatagtacaatgaattataatcctttgggtatataccccgtaatgggattgctgggtcaaatgatgtttctggttctagatccttgaggaatctccatactgccttccacaatggttgaactaatttatactcccaccaacagtgtaaaagcgttcctatttctccatatcctctccagcatctgttatcttgtaaatttctttatcttccttgtagattttgcatattagccctttgtcagatggaaagattacaaaaattttctcccattctgtaggttgcctgttcactctgatgatagtttattttgctgtacggaagctctttagtttaattagatcccatttgtcagttttgacttttgttgtcattccttttggtgtcttagccatgaagtctttgcccatgcctatgtcctgaatggtattgcctatgttttcttctagggtttttatggttttaggtcttacatttaagtctttaatccatcttgagttaagttttgtatgaggtgtaaggaaggggcccagtttcagttttctgcctatggctagccagttttcccaacaccatttattaaatagggaatcctttccccattgcttgtttttgtcaggtctgtcaaagatcagattgttgtagatgtgtggcgttatttctgaggcctctgttctgttccattggtctatatatttgttttggtaccagtaccatgctgttttggttactgtagccttgtagtataatttgaggtcgggtaatgtgatgcctccagctttattccttttgcttaggattgtcttggctatacaggctcttttttggttccatgtgaaatttaaagtagttttttctaattatgtgaagaaaatcagtggtagcttgatggggatagtattgaatctgtaaattactttgggcagtatggccattttgaagacattaattcttcctatccatgaacatggaatgttttttcatttgattgtgtcctatcttatttccttgagcagtggtttgtagttctccttgaagaggtccttcacgtcccttgtaagttgtattcctaggtattttattctctttgtagcaattgcaaatgggagttcactcatgatttagctctctgtttgtctattattggcatacaggaatgcttgtgatttttgcacattgattttgtatcctgagactttgatgaagttgcttatcaacttaaggagattttgggctgagacgatggggttttctaaatataccatcatgtcatctgcaaacagagacaatttgacttcctctcttcctatttgaataccctttatttctttctcttgcctggttgccctggccagaacttccaatactaagttgaatagctttaaaaccatggtgatgttgatgttcttcacacacatctgcccttgtttcttttaggcactagcaacaaatggaattttcaagagatttttatatacatcacaaggtagataaaaaaaaatttttggaggagctatttgtaaagctcaaatgcagaaaaacacaaattttagaacattcaaactaaaaagacagtggactatgagctccttgagaggagtatttctactccttagctctaggtctagtgtataacagatgcttagtaaacaaatgatgagtaagtaaccagtataactttttaattttactatttttgaaaccgaggcccaaaggagttaaataattctatgtggttgcacgaactaatggcagaagagaaataagagaattctggtctcttgaatctcattctacgcaatgccctttcctctataatactatgtttcttctaatttatttatgttgtttcctcaatcctcatttccaatgacttgggttgagtaggtgaattttttttaggctatgttccaatatcaggtttcactctcacaacacagaaagcataggcactaaactaatgcatgtacattatccttttaaggttaataacgattcttccaaaagcagatcagttcttatttgctgtcactaccataggttgaatctcagcagtgacaaccaatactaatgtacaacataaccttttctcattaaagaggtagtgggaaacataggtgcaagaacattttcttactaaattatcaagttgagttactcactcttgtatatatatctgcttctgtgacatactgcatgatccttcaagaagtgtcatcctattgatacgctgggagaggggtttcacaagagttgccagataaaatataggatgcccagttacatttcaaccctagataaacagttaaattttttttagtataaataggtcacaaatgggacttatttgctaaatctggcaaccctaggttatttgtcatgcctaaacacccaaggatgtcccaatctgctgacagcctgctcttcattgcttgattttagtagttgtgattgctttgctcaccaaccactttactgtgtgtagtgaatcttcagagcattattgtgggccagttgctaatgctggcaatttacatgacctgttaacagattagtgatgcaggcataaacagaatcccttccccagagtcttatgggagctgggaccaagccttccaccttatttgtcatcatattcaaacacatatctctttttgatatacataaaagcttatgtccctgaactccattgagagtgttattttctgtagcttctttatgaaaatatatcttttccattttacaaatataaaattatattatgatagtaagcatgctttttcaagctacacttcatataacactactctaaagattttgaaatccatctcttgagaataaggcccccaactgagaatcagtggtctatgagataccaaaacaaatcaatgagaagtcaagtactcaatcaagctactaatttttcaattacttaaatatattttttttctaaatcagtgttactcaaagagtgactttttatgtaacaaaggttaaataataataacataattatgttaatgtttatttaaaatattggtttttctattctgttttagtgattaaaaatttcagtttggaatccactggtttacctaaaagtaaagaaatagttagcttttaaagaatctattaacttccaattccctatcccctctaagttgaccagccatttggactttttctgcgtaagcagaagactactgcatttaaagatgacaggctacatacaaatctgaaaagctttttattgttgtccacaattgttacattataatatcttgcatttgttttcatatatccattcaacatggggatataattatattattcccatctagcagatgaggaagctaaaactcacagtgaagagatgcctcgttacactattgaggattagattataatctttattgtaaatcttagcttgtttttagttttattgaattagtttttataattacattattgcatatttctgtgcctcaggagtctattgatatatgaactattaggtttaaaggaggaaggttttatgagaagatgaatatccagataattatagccctaaaaaagaagcttagatagatgtgttaattctgcttataggtatttgtttaatttttatccaaataacggtttagcatcattccaagagatatttaacaaaaatgttttctattgtatcatccacttgtggattaagcttgctgagatgttgtagtagtccagagtttacacacttaatctggttaggctgttgcctgccaattaactgtagtttattgactcttttcaagttggataacacagtgactcagaaatctttaccccctgatttaattaacctgtaataaatattaaactgatttctgagattatcacattttactcaaatgcgaactatcatttgtcatatccagtcatatccagtcttcttaaatgaaggaaaacacaaattacataggtaattttttggcagaagagtatgaaaacaccattttactatttaattcagcacccaatattagcacttcatgttaacaaaaggcagaaatgaataattaggatcttccatggttactataatataaattatacattttaaggttattgcagattaaaatattcagtactgattactattaaaattaaatactaagatatttatcagattcactttaaaatgcatagtctatcttgaaacaaaatttctgcagcaataaaatttagataaaatgtcaaaaatcctaacttaaagcaatcgttttgtagttaatcttcatgtatgattgcccatcccaatttgcctagacattctgatttttgacaatcagtatagtcttctctgtttatcctcataaaatgtctaacagggttatgagctgctttggagatgaggacaatgaaatgcagaaaaaataagtaacttcacaaaggaccttcataaagcttcttcctcagccaacactagatagaactgtagctattgaacattttggagctctgtttttctgatggcaaaaccattcataggaaaagtgaaacactgctgttacctaagcataatgcccaacttttaggcactttaaaaacatctggttgattattttcacttgtaaatcagatagttgacaaccttgtatacttgtgtatatatttacagaaagttagaatgccctgttactcaaccgactagatactgaattacctcaagtaatacccttgaattgttttaatattatatacatacattcttggtattgtgctatatcagcgttttcatgtttccttccattagccttcatttaaattgattttaagtataacaaaagctaattcacattaaatgtagtgcgcatttgatttggagtgagttttttttacaaatattattattatgctatcctatgaatatctaagtcatttccaactggatatagaaattattaaggtatatattaaatgaaacactttagttattagaaactatagaactgtctctgggtatggtggtttgattaaattattacaattatataatgcttttattctaaagtacgatgctaaatatatttaacttgaatgtctacttcagtactttaaagttctaaggagtcaattcgcttctaagcgtgtagtctcattttagtgtttgaaagtgggtaagaatctgttcttgtttctttttttaagttttcttattttactttactttaaattccaggatacatgtgcagaatgagcaagtgttttacataggtatacatgtgccatggtggtttgctgtacctatcaatccgtcatgtaggttttaagccccacatgcattaggtatttctcctaatgctctccttccccatggctcccaccccacgacaggccctggtgtgtgctgttcctctagctgtgtccatgtgttgtcattgttcaactcccacttatgagtgagaacatgtggtgtttcgttttctgttcctgtgttagtttgctgaggatgatggcttccagtttcatccatgtccctgcaaaggacatgatctcattctttttattggctgcatagtattccatggtgtatatgtaccacatttttttccagtctatcataggtgggcatttgggttggttccatgtctttgctattgtaaatagtgctgcaataaacatacgtgtgcatgtgtctttgtagtagaataatttatattcttttgggtatatacccagtaattggattgctgggtcaaatgatattcctggttctagatccctgaggaatcgccacgctgtcttccacggtggttaaactaatttacattccaatcaacagtgtaaaagcattcctatttctccacagcctcacgagcatctgttgtttcttgactttttaataattgccattctgactggcatgagatgttatctggttgtggttttaatttgcatttctctagtgaccagtgatgatgagctttttttcatatgtctgttgttggcaacataaatgtcttcttttgagaagtgtctgctcatatcctttgcccactttttgatggggttgtttgtttcttctggcaaatttgtttacaaatttgttgtagattctggatattagacctttgtcagataggtagattgcaaaaattttctcccattctgtaggtttcctgttcactctgatgatagtttcttttgctgtgcagaagctctctagtttaattagatccatttgtcaattttggcttttgttgcactagcttttggtgtttttgtcatgaagtctttgcccatgcccatgtcctgattggtattacctacgttttcttctagggtttttatggttttgggttttacatttaactcttaaatccatctcgagttaatctttgtataaggggtaaggaaggggtccagtttcagttttctgcatttggctagccagttttcctagcaccatttattgaatggggaatcctttcccaattgcttgtttttgtcaggtttgtagaagatcagatggttgtagatgtgtggtgttatttctgaggtatctgttctgttccattggcctatatgtctgtttgggtaccagtaccatgctgttttggtaactgtaaccttgtagtataatttgaagttaggtagtgtgatacctgcagctttgttctttttgcttaggattgtcttggctatatggcctctttttcggttccacatgtaatttaaaatgtttttttttttttttttagacggagtcttgctctgttgcccagcctggagtgcagtggcgcgatctcggctccctgcaagctccacctcccaggttcatgccattctcctgcctcagcctcctgagtagctgggactacaggcacccgccaccgcgcccagctaattttttgtatttttagtagagacagtgtttcatcgtgttagccaggatggtctcgatctcctgacctcatgatccgcccgtctcggcctcccaaagtgctgtgattacaggcttgagccactgcgcccggcctgtttttttttttttctaattctgtgaagaatgtcaatggtagtttgatgggaatagcactgaatctaaaaattactttgggcagtatggccattttcaagatattgattcttcctatccctgagaatggaatgtttttctatttgtttgtgtcctctcttatttccttgagcagtagtttgtagttctccatgaagagatccttcatgtcccttgttagctgtattcctaggtattatattttctttgtagcagttgtgaatgggagttcactcatgatttggctctctgcttgtctattgttggtgtataggaatgcttgtgatttttgcacattggttttatattttgagactttgctgaagttgcttatcagcttatggagttttgaagctgagatgatggggtttttaaaatatagaatcatgtcatttgcaaacaatttgacttcctcgcttcctatttgaatacccttcatttctttctcttgcctgattgccctagccagaacttccattactgtgttgaataggactggtgcaagagggcatccttgtcttgtgccagtttttaaagggaatgcctccagcttttgcccattcagtatgaaattggctatgggtttgtcatgaatggctcttattattttgagatatgttccatcaatacccagtttattgagagtttttaacatgaagggatgttgaattttattgaaggccttttctgcatctattgagataatcatgtggtttttgtcattagttctgtttatgtgatggattacattgattgatttgtatatgttgaaccagccttgcaacccagggatgaagctgacttgatagtgttggataagctttttgatgtgctgctggattcagtttgccagtattttattgaggattttcaaatcaatgttcatcagggatattggcctgaagttttctttttttgttgtatctctgtctggttttggtatcaggatgatgctggcctcatacaatgagttagggaggtgtctctccttttcaatggtttggaatagtttcagaaggaatggtaccagctcctctttgtacctctggtagaacttggccgtgaatccatctcctgggaattttttgattgacaggctattaattactgcctcaatttcagaacttgatattggtctattcagggattcaacttcttccttgtttagtcttgggagggtatgtgtatccaggaatttatccatttattctagcttttgtagtttatttgtgtagagttgtttttagtattctctaatggtagtttgtatttctgtgggggcagtggtgaaatcccctttatcattttttattgtgtctatctgactcttctctctttccttatttattagtctagctagtggtctatttttttttttccggaaaaaaaaaaaaaacagctcctggatttattgattttttgaagggttttttgtgtctctgtctccttcagttctgcactgatcttagttatttcttgtcttctactagcttttggatctgttttctcttgcttctctagctcttttaattgtgatgttagggtgtcgacttcagatctttctagctttctgatgtgggcctttagtgctataactttccctcttaacactgcgttagctgtgtcctagagattctggtacattgtctttttgttctcattggtttcaaagaacttcttgatttctgccttaattttgttatttacccaggagtcattcaggagccggttgttcaatttccagtgagttgtgttgtattagtgagtttctggatcctgagttctaatttgtttgcactgtggtctgagagactgtttcttatgatttcagttcttttgcacttgctgaggagtgttttacttccaattacgtggttggttttccaataagtgccatgtggcactgagaagaatgtatattttgttgatttggggtgaagaattctgaacatgtctattaggtccacttgatccacagctaagttcaagtcctgaatatccttgttaattttctgtcttgttgatatgtctaatattgacaacggagtgttaaagtccttcactgttattgtgtaggagtctaagtctctttgtaggtctctaaaaacttgttttattaatctgggtactcctgtattgggtgcatatatatttaggatagttagctcttcttcttgaattgatccctttatgattatataatgcccttttttgtctttttgattttttttttcgtttaacatttgttttattagagactaggattgcaacccctgctcttttttgctttccatttgctgggtaaatttttctccatccctttattttaagcctatatgtgtctttgcatgtgagattggtctcctgaatacagcacaccaatgggtcttgactctttatcctatttgccagtctgtgtcttttaattggggaatttagtccatttaaatttaaggttaatattgttatatatgaatttgttcttgtcatcatgatgctagctggttattttgcacactagttgatgcagtttcttcacaacatcattggtctttatattttggtgtgtttttgcagtggctggtactggtttttcctttctgtatttagtgcttccttcaggagctcttgcaaggcaggcctggtggtgatgaaatcccttagcatttgcttgtctggaaagtattttatttctccttcacttatgaagcttagtctggctggatatcaaattctggattgaaaattctttaagaatgttgaatattggcccccactctcttctggcttgtagggtttctgctgagaggtctgctgttattctgatgggcttccctttataggtgacctggcttttctctctggctgcctttaacattttttccccttcatttcaaccttggaaaatctgaagattacgtgtcttggggttgatcttctcttggagtatcttagtggtgttctctgtatttcctgaatttgaatgttggcctgtcttgctaggttggggaagttctcctggacaatatcctgaagtgtgttttccaacttggttccattctcccagtctgtttcagatactccaatcaattgtaggttcggtctttttacatagtccatgtttctcagaggttttttttttttctcgttcctttttattcttttttctctaatgttgtctgcgtgccttatttcagcaagatagtcttcaaactctgatatcctttcttccacttgatcagtccggctattgatacttgtgtgtgcttcacgaagttcttgtgctgcatttttcagctccatcaggtcatttatattcctctctaaactggtttttctagttagcagctctgtaactttttattaaggtttttagcttctttgcattgggttagaacattctcctttagctcagtggagtttgttattacccaccttctgaagcctacttctttcgatttatccatctcattctctgtccagttctacacctttgctggaggggtgttgcaatcatttggaggagaagaggcattctggcttttggaaatttcagcatttttacactggtttttcctcatctttgtggatgtatctacctttgatctttgaggctgatgacctttggatgggtttttttgttggggggaggttcttttgtgttgacattgttgctgtttttacttcctgtttgttagtttttcttctaacagtcaagccccccttctgcaggtctgctacaatttgctgggtgtccactcgagaccctgttcgtctggctattaccagtggaggctacagaatagcaaagattgtggtctgctcttacctttggaagctttgtttcagaggggcaccagcctgatgccaaccagagttctcctgtatgaagtgtctgttgacccctgttgggaagtctctctcaatcaggaggcatggggccagggacccacttgaggaggctgtttgtcccttagcactgtgctgggagaatcccccttgtcaggatcagccgcactcttcagagtcaggcaggaaagattaagtctgctgaacctgtgactgcaggcttccctccccacaggtgctctgtcccaggtaggtgagagttctgtctgtaagcccctcactggagctgctggatttcctgcagagatgccctgcctaatgagggggaatctagagaagcagtctggccacagctgctttgctgcactgtggtgaattccacccagtccaaacctcccagtctccttagcactgtcaggggaaaaccacctactaaagctacaataatggtggtcacccctctccctaccaaactcgattgccccaggccaacttcagactgctctgctggcagtgagaatctcagtccagtggttctcagcttgctaagctccgtgggagtcagacccactgagcaagaccgcttggctccctggtttcagccccctttccaggggagtgggcggttctcctgtctcactggagttccaggagctgctggagtatgagaaaactcctgcagcctagtgcctgcctgaaaagccacccagttttgtgctcaaaacctggggctctagtggtataggctcacaagggaatctcttgatctgcagattgcaaaaatccgtgggaaaagtgtagtaccctgggtaggtggcacagtcacttaatagcttcccttggctgggggaaggaggccccctggctccgtgcacttcccaggtgaagcgacgtcccatcctgcttctgctcgctctccatgggtcgcacccactgtctaacaagtcgcaatgagataaactgggtacctcagttggaaatgcagaaatcacccgcctctgcattggtctcactgggagctgctggagctgtttccattcagccatcttggcccctcccccttagtttctatcattggaatattgcattatttttccttgaaagttttcttgaacatgtagagcaaacaaaccctagactctactagtggaacattgatcaaaatatgtttcatagagatgttccttaaacaaacaaaatacacacacacacacacacacacacacacacacacacaaccaagtcaggtcaaaagattgtttaatacactggggaaatactgcacacttaaggttgtgtctcttgcagaattccaatgcataatagtttattagaggctctgaaaagctcttcaataaagaaagctgtttatttaatccatgatttcccaaactgatttggccatagaattatttgtgtgtgtgtgtgtgtgtgtgtgtgtgtgtgtgtgtgtgtatgtatacatcttttagcatcctgaagaattagtattatgtggagcacacttttgataatgctggtctaatttctttcagactgaattttgaatagaaatttagttttctggaaagaggataaggtcaagaggcaggagaccaaaaggcacatatttgctgagtaattaagtcagtaagtgagtgagtgaattaatgagtcatggtttctgttctgtcactaacttgctctagtatcctgagccagtcgtttcaatatttgattattaaacgttcttgtgtaaaagcatgtaagattacttgccctaattacttagtagatgttgaaaaataatagaaattaaagtattttgaaagcaaaagtaattaaaaaagaaaaaaacatagaaaatgttttgctctttttatatacagaactatttagaggagaaatatgatgatgtcttggagttactttaaaatacattagctaaaatataaatgaagcaaatttaacaaaatattaataattaaacaatatagttgataggtatatgtgtgtttattctgctattctatttctatgtatgtttgaaattattcaaagtaaaaagttttaaaaattcaaaaaagtattatgctgtttgtatgtaaagttgcaattactaatacagacgttgattttatagaacagtgtatgggattgcaaagaagcatgattattttgtcatcttgtcctccctgtaaccaagggcagacatttgttgaactgtcatgtctggttagggtggttacctcagaattttcctttgtgtaatatctgctggctaaaataagatttgaacttgaaacctagggttcattatgaccgtgccctgacatagtaattcccaaagcgtgttctgtggacccatagcaacaacattacttggaacttgtcaaaatgaaaatccacaggctctatctcatgcttactgaatcagaaatgctcggagtgggttccagtaacctgtgttgtaacaaggctgccagatgattttgatgcttgttcagatttgagaatcacctgttgtgttgatctacaacacaagactgaagtgcaatatgaaaactctatttccgtcattactcattagtattgtggtgtcatacattccataaagtcttaattctataatagaaaacagtaaacaggaattctattattgattaacttaacatctttctccatcgttagatgattgtttacacaggttgagtagatggagttaggacctgagaacgtgtgtgtgtactgtgttaatgacctgagaaccctgatgcatgtcacaatggcccgacccactcaaggcatgcttactggatggaaagagaagttttcattgtgcagatgtatttagacacatcattccagttgttgatgtcttattatcttggttttgtgacaaggatattctatccccatgcctgaagcatgtttaaaagcacacaagttactggagcacagtgcttgggttcagttgccatttaactagtagctggtcactgaggtggaacggcccctttcaaatttggtaaaaagaaaaaaaaacccatagccatgaggttgaggcttctaaaagttataaagcagcccacaaactctttccccttgaggctttatgttagaggtggctaacatcttatatcttgaaaataaaattcttaatcaagcttcttcagagaaatccataaagctttgtactctactattaacttattgaattggagaagaatcatttctataccggtggaaattgatgaggaaatggaaatatggggacctttctctaattgaatagttggcattatgtatgtattctaaattcagagtaatatagccctttattcttacatttttaaatgaagaggaccattttgttgatcatatttcactttttaagataacacttgccaaaagttcttccctaatgtttatggaaaggaggatcaggcatagcatcacaggtaatttcctcaaactttttcctacttctctagtcccacttaaagatggcagaagcttttgcttctgtagagaccatggccatttctaatactgacatctgtagtgtgagatccactggcactgctctgctggaaaattgagggcatgttttaaccttttacagtcaatcagtattgcactaggttttgctatctataatgttccttttcctgcctacttctaatttgttcaattctagagcaattaaggactgcaaaaatttctgaatcccatttaacaaatcccatggaacagttgagaaggcaatttataaagtagtgaggagtaaaaccaggagacccttggtttgtaaaggctggacccattcctgggtctttatctggcagttgctgtagcagcatatagtgaggaggaaaagctgagggaacaagtcttatggaagcagtccattttattattttgcttgattttttcctaaatctatatgaaacattttagctgaaacccatctgacaaaggcttgattttgtgtgtcaaatgtacagcaataaatgttgaagctgtttttatattggggactctgggcaggaaactgggctgtcattctaggacaggttaaaggcaagtctgtgatggaaaagggcaaggttcaggaaactcaggagtaacaagacacttttgagttttggctgaagcaggaaacgaccctagataactcacagggagagaaagtgtcttagaggacaggtctgattgaaggcctttatatacacaacccaaggtctcctctgttggctccagaaggtgtcatctacttctttcagtattaaaagaaatttaccgagtttggaccttgaataaaaacatacttatggagctccttgctctctaggaaagaagataggcattctatagcagttacaatcatagcgaaagaccagggtgctataggagcccaattgtgaagcactatgcaattgaaactctcattcattcactaaacaaacattttaacaacatactgtataccaactacattccaggcactaggtgctgagaatgtagcagtgaataaaaaagacatgactcttgctttcctggggcttataatccaagaaggaataaacttaaacatttatactccctatttgtgatcagttgagtcattctggaatcatataaactttcatgacaggaggtagggcctcatcttttgacctgacttgatcttgtgtgtgtgtgtgtgtgtgtgtgtgtgtgtgtgtgtgtgtgtgtgtgatctctctagacagatggactggaggtagagagagctgtgtgtgtgtgtgtgtgtgtgtgtgtgtgtgtgtgtatctatctatagtttgttatagcagttagtactactgttgtactagaggtagagagaggtgtatatatacaacaaagaatcctcaaatcacagtggctaaatacaatgaaagtttatagtccaatgtgtattggactattaggaataaacaggggttgagggattctgctctgcattcatgcctcccattttgacacatagccttttcctactctgcattgttacatatccttttatggacatattttatctccataactaagtttctagcctcctctagattcttagacctctttgtttccctagtgactatcatgtctgttgaagataactttctagatttgtgtacattattaaatcaaataatggagtagattcaaaatgagtagaattatagatggttaaagcagagaaaagaacttagagattgtttagtttcaagtaccttgttttacagatgaggaaactgaaatctggaaaatagtcctaaagtctatcatttctctcagtgaatctcacctaactcagtcaaccaagtggaggccctatctcatatagaaagggcgctgccagaccagaggagttaatagctaataaatcatagtatgtcctgctttctattaccttgtaagttagaatagaggggcattttagctaattcacattattcacttttctggtgcttggactctcttatttcataaacttatctgtaaatggattatttcaactatatagcagaatttgaaaagaatcaaagttattaaaaaaaaaacaaggtcacccatacaattatgagatgtctggagtatagtcttttaggatactgagtaagcccttggcaggtttattatgagccaagtcttctctggaatttaatcaatgcactaatttgaattggaacaaatgggaaaaaaaaacaaaggaggctttcttttcaattcaattcaaagtaaattgtattccagagaagtcagtctctggttggaattggaagcctctggtggccttaaaagctagaaacatgagtctcaacctcatgtaatgaggagctcaagatgagtttaggaaggattttatttcagaagatatctcttgaatgactaggcttgctggccagaaaaaaagccagttggttgcaacaagttcaacatgtacgtggtcatttcttattgtatgtaaaaaaccagactcactcagggtttagaattttccatgcagtttagcattctgtgcataaaaataaagacatgttttgatatgaagacaagcatcttctgctcatgccagaatctaacttaacatgcattaacatgtctcctttcatatttataatgtttgcattttagaaacatgagcctcctaaaggaattctggaaatataaatcctataaaacaatgtaactttccttggttcatttactggcttgtctatcctgacataaatagaaagacggccccagtgttcagggacttctgttactctcagccatgagtttcaggtgaacgttcaagtttctatattttacttgctctacgtcagatagtattttcaattattaaaaccataatcctgaagacaagcatactttttgtagcttacttgtaaatttgtaattttaacaacttagtttatgctgaacatgaataataaactatcacctattaaacctagagagcaccagaagttactaatatgatttacaatgcactgcaaaaatgggattcattattatctcacactttaaaaatttgcagtagagtagtgtaaacaagtatttactttaattaaagaaataacaagggttttgtagggctgtattttatgtaaaaaataagtatccaataaccagaaagttcatacttgttaaaaagaatgtcgtgcattaactgaatcttaccagaaaatctgctcatctgtttgaaagacaataaggtgtttctaaaagcttatctacacactgctgatggcccttttcagttcttgccagcaattcctgtctttaaagcaaggtcagtgggagggcctttactcaagggaaagagaatttgaagtatccatgttacttttcttttctttccttaaattgcctttgtagagcaagacatttattagtgggccttgacagatccttgagacttacaaaatcaccggtagaaggataataggctaactttagatcatgttcaaactcctcagctggtaatcacttagcaaccccctccccatgtaatctgagtccatcatactatctatgcttgtctctcactgtgctccagatagtaacatctgcttttgctgatgtttggtttaaaaatgtattttaggacagctcctatttcatttgaattagactctttgtcaagtctgcttttattagttaatcacgtcagattcctctaccctacatagatgatccctcacggaaatttaacttgttcttcaagcccaggttcatccctacttccttccatgaagcccttgtcaagtaatctagtacatgctgatttctacacatttgaatatccatactatttataatgtatctgtgcttgcgtatctcatatgtaggaatactattctttaatagtcttacataaaatgtataacctgttaattataatataaaacatttacattttaatatgaacacacatactagaaccagaattaatagagttaagacattttcttctagggaagctattattgatttgaaagatgcttctcctgctctagaattttgggtgaatgttttcagaaaaaaagtcatctaatttcttcatgccacatcatgtttttgttcccaaatgaatttatccggattgatatcgcacttcatttgacctagttaattccaacttatttttttcagtatttataaaatttaaattcaacctcaaagaaagattcctcctagtgaataggctaaaagtgtgtttcagatttagaacacaattactaaagaagaattccagaaatgtttgcaagtgtaataagtgcatggtttcctaattgactaaagatgatccttattcattgtataaatttgtctatactgttaacagtaaatctatgattactatgttcacatgaggcatatattgaagtatacatccaagtcttattgctttaacaagaatgcaagctcacacctcaaccagacatttaacctcaggaaagttacttaaatactctgcctcatttttcccataagtcaaatgattttagtaatgcctatctcataggatgctgtgtagagtaaatgagagtacatgaaaatcagttatacactgagcttgccatgtggtaaatactcagtaaacattagctgctatcatcgttaatactattatcattgtttttttttttttagaaatacttgttcaccttcttttcttaaatgctgttgtcgaattttatattttgaattctagtcttcttatattcaggtgaccatgcatagccctcccgctaaaattatcttcatctgtttttgagcttactccttttcttgaaacctctcagtggctcccctttcaattttattttaacgtcaatctccttgaatccaatttcaatgcatatattctattacattccttgaagtcagggactatacttctttatggtatcaagtatcatgtaaatttcattaataaataacaacaatatcatagctacataaaaagaaactagtggcaatctgagagacacttaggggaaatccttgtgggaaatccttttttttttttttttttctctaaaatgaaactctccattttgaagccacacactgataggccataatgcggaatcacacatgaagcaattggaaaactcatcttttctgaaatgaatatggacaactgatgttgttaataagcaaatgcaaggatcattgccttgaccttctatataggtgaaaacaatggtttaggaaatgaaggctttccagggtggtgtaaagaatagtcagaggttgttctacttgaacaaccttactatccatgttgaaaatgggataagggagcaatcagatctaaagtggaaaattacagcccaatttgtgttcaggtctcctctgtgtctccttttggtgtccagagccactgcctcacaccagcccaaaatgtaccagggaatgagagactttggcatttgagagggtacacaatctaagttcttatcgttcacttgacctaaattaatggcagcattaatgatgaaagcacaccagtaatgttaaagcacattaaactgagatcttttgtctctgcagagtaatgttctgttttgagatttctcattatgcaaagtaatgaaacagccaaatcactatgtacatctgtgtttgtcgatacttgacatttggttttaaagtgaggtttaggaggacccttatttaatctgggttggactcttctgtgatccaatttatttgctgccatttggatttcatttctgtagttgagcatccagttgccccaatataaatttaaaaggccctcttcctttaattaattatacttactatattctgtaccataattcagctcattcactttgaagagttggaatgaacagtatctcagggccatagacatggcactctcaactaaagctgtgctttggaggaatattggaatacagttgtaattgctattggctcaaattcaaatttcttaattgggcattctaggccttccataatctggccctgatttgccttatcctttcataaaatctcttgtacgtcccctgaacatggtagtagcctaataaatcagttatattcttccttctcccaggccttccccattgtactttagtcaagctgatgtcttcaccgtcttttaaagtctactgaaatctcaccctttctttggaagttttccttgtgctatagcatccacttcgctttctctcttttctttaatttctttggggctaagtgctagatgctggtactagttgataaatgtttcacatgggtagatcttttcaacaagattatgatggccaagtgggcaaggactgcattctcttgatgtatatcctccatagtgtctgacacagtgctaagcttataaaaaacacttactgatctatgctcaagaggttgattagcctgctgtaccttcgaaattgcttatttgatgagtatatattgcctaccatgagggagattctgaggatgtggaaattttatgatgaataaaatatagggttgaatttcatttgaagctgcaattatattattctgggtggataaaagtgtgtgtgtgtgtgtgtgtgtgtggtttttttttttttagtcatatgtcttttagctgtaatggaatcagtaaatcccctcctgatttaacatggaatctgttggtaagcagctgctgggtttctaatcctgaaatccagaaaataaaattggactttcaactggaatatctatttttaggagtgctgtattagacaaacgttttcctatgaaccactcagaacccaactacatctgtaagttagttgctaacatagggcaacctcaattaattacggttttgtgtcatgaaaatattttcagggacttaggagtgtttgcaaaaagctaggtcagaaagttaatgtgaagaaggattaaagaatttgaaagatcaggcacctattagatgattatagtacttcaggattataacttggattttctaaagaatatgcacaattctcagatttcactattaaaagtccacttattggtttaaaataaaaaccttccataagtagattttccagaagagcatttcataaattttctttattatttcacttagcttaaaaagtataaagtgcacatatttcaacttggattttttcaagaaagaatagtgttctctttggttttttttccttccaaatgagtaacaacttagtctatgaaaggttatttgtgatgtttctatgaaaactgtaggtattttaaagaaaaataaaattcagaaacccaggtcagcaaattgaaagtattgggaaactttttttcaaaaggaacttaaatatgcttataacagcactacatgttttccttctatggttagtgctcaaatatttccttttaaaattaacatacatactactttgatgataataacaacaatctgtactcaccttcttcaaggcatatgatttattattgtagtagtgggactgaattgctgatgcattcatatactccccttggtgaaaaattcgatgcatacgtgtagcatctggcagaagttaggggcttagtttgtagccaacaaatagaaaaatgctaaatgtcccaatcctgtgttgttggcctaaataggagcagcattgtgccttgaaaaattctatgctaggactcaggaaacttggattctaactgtgtgaacttctggaaattcatgcattcatttattaaattaatatttattgaactaagaacaaggcactgggctgggtattgaggcagtagaatacaatagacaagattcctgccatgatggaacttacagtctagtggtaaagacagacagtattaaaataattacacatataaactgtattattatacctgtggtacgtacatggaagggaagatacagcgctatataaaagcatataatatgaggatttgacatagttaggaaggtcagaacctacttccctgaggaaattatgattagtaaactaagcaaaggaggagggacagtgttctaggaaaaagagaagcatgtacaaaggccctgtggtgtgagggagcttgatgagtttaaaggattgcaagcaaggcagaatggttagagtagaaggagtggagaggcaaatggcacaagtgaggctgcaggcatcaacaggggctagattgtatagggcctttacgaacattaaaagagtttgccctttatcctaagatcagtgggaagcctttgtagagtttcaagcagagaaatgatggataagatttgaattttgaaaagataactctgactacagtatgaaaagcaaatcagaaagtgtccagagaaggatggagatcacttatgagactgtggcagtcattcaggaacgtgatggtggcaggttgaacaaggatagtggcagtgaagagaagtggaaagattcaatagagaagatatgaaattggaggagcctagactcgatgcagaggtgatcaagagggcactgtcaaggataactcatagatttcaggctcatttaactgggtagatggtgtgtcattccttgaaatgaagaacactatagaactgcgattgttttgtcacggccaggagggtaacagaggtcatgaatttctttatcagatatgttgagtttcagttatttttaacttgtttggacctcagtttcctaatctataagataaggacaatgaacctctgagatctcttctagagcagggcttggcaaacttcttttgtaaagggaaggatagtatttttagttttgtggactgaaactacttcactcagctgttatagctggactaaagcattgaacctcagttatccagatatagcaatccttagaccatgtcaacacaaacctgccaattgatttggtcaattgccaaaaaaaaaaaaaaaaaaaaaagtcagtcaattaaatgaagaattgattgtgtcatgagttaatgagtcaaatcagtaaaattagttgatatagtagacttgagggggatatacctatatgtattatgattacagtagaccctgccaccaacaaaagggatgacaatcaggagaatatggctgacccacccatggaaaagctgagtaaagcaaatcagaaaaatcatcatgaaaatagggctatactaagcacttactatttgagtagaagttactgttattgctgatgttgcctcctgttagtcatggatgttgccactatcactgtcttgaggcatcaagtatgactagtgggacagcccagtaatggagatgctgtgtgtgtgtatttgtgtgtgtgtgtatttgtgtgtgtgtgtgtgtgcatgcacacgtatgcatttagggaaataaaattatatagtaaatattataatctacttttttcacttaatgaatgttttggacatttactaattttgttaactttttgttgagattatacttaatcttaactttgtgggtggtctgtatttaattctcatttgtctttggccttgtcacctaatatttctctgaagtagcttcctctcatcctcagttggtatatattttgcctatagcactcctcaatgaatattcgtgcgggggtagggtagaagcatcttataatgtacttctaaagctcagtacatatagggtttgaataatatgctgttttggatgaaatgattttctactcctcaacattaatagggataatcaggggttaaccatgtttgaacatgacttatataataagtatgcaaaatgaggcttctgagtatatagactacggcaattgggtgaataattgactatctcaggaaaaagtaaaaattttaatcgaatcatacccataattcattcttataaaatactagctcatttccattcttttcagcttgttatgaatgaatataagaaaactaagctttaaagccaaagatattcttcatgaaattctttccatttgagacaggtagattgacatttccatgatttatttaatgagataccttctctcccatgctatattattgttatttaatatttattgaacactctaaccggagatggttggaggggagaagcagagagtttgtcaagtcttagcttacactggttatgagcagaagttttagctatagcactgaatcaaagccactagtcttgtctatttagagaccaagggagagctttctcgttggccctctgaaagtttgctgaaaatcactaacaagaggcatattaattggagaaaatgcatacaaatgtatttaatatgtatatatggcagccttcagaatgaagacccaaagatacagagcacactctccagttcaatgaaggataaatagccatgtatatatataacttgacaataaaagaatatgatacaatgctaatagaaatagagcagggaagcccagcatggtctgtctgtccagattcttcttgtcctctttgagcatgcattctttccttctgggtattgggcaggtccttccctggaatgagggtcttataacctacggtcaaccgagataggtcagataatttcttcatagccagtttttacacagaaaggaagagggaaagttacaataacacatttaggttttatggctggctttggagaaagggggttattgtttctctgacctgccttggagaacaggggttctagtttctatgactagtcttcggggagaatgggactaagagacaggagggcaggagaaggtcagagagaagcttttgcttatgaggctgcttctgaggccttcattttggggtgttgttttctgatccccaacactatcatgatgaaacatgaccagcaataggggagcccaaactaagagtggacaaaatctggaagccagaaagagggctaggcagagcattacaaagatccaggacagtcttggcagtggggagcaggaggaagtttagacctgtgattatcctcaaggaagcccagcagtaaattaaaaacctagtaagcatgttgagcatgcttcagggaaggccagtagcagatattcaggtattttggtagtcagtaaatgtcaggtctagctctgtcaggagatgatggggcctgaggtttggagcctgatttcccttccttagaaggacttttgtgagtgtgttaccctaggcttggaggaatgatagatttaagcaagggatttacaaagaggcaaggtaaggagttggttcctggaactgggatcaaggatgggacttaattttaaaggaacaatggtgaaatactaatagaggttataggctcagaacaagtctagcagcaaagctgatttgatgtcagacaattgagtcacttataccctttatattattctacttgcctaattcgttggtcctagagtcccaggttcaggaatgggggtgggagcattgaagataaatgtggggttaatgacacgactgcttatattagaagaatatggagtaaaaaaattaagtatcctatcattatcagagcaggaaaagtagtacaaattccccttttttgcatcatcatttggctgaaaattataatagaaatgtagtcctgagaaccacttgctacatgaattttaattttctcttctctctctctctgtctctctctgtctctctgtctctctctgtctctctccctctctcccccactccccgacacacacacatcccactcacactcacaaatacatggatccacaagaagggcatagctagcctttagtgtacatggccttatctgtggtgtgatgtgcttgcctcaaccttagcagtctcccactatgaacattacaaaatccctctactggctactcctcttttaagaagagatggttgctgcatggtttgtttggaggaaatatgtttcagagaagacacagaggagtagaaagtatcagtgtgtccagggctggtcctatatgaagctcctaagtaagagtaaaatctacctttgcctttctctcatatcacctttcaatctccttctccccaacatggcaggatatcagattaagttcagattcatctgttcaacaacaaatgcacaatcatatggcttcagtctgtctataggaaatctgaggttctcttcaggcacctaattcttctctgtctctgagtaaggttaaaaattaatttattcctgttcatggccttagtgactagcacagtgtctgtcataggcactcaagggagtttgctacttaagtgagtaaatgttgttcccttgctactcaaagttgccgaccatggagtgctacctaggctagaatacctgagctcctccctagcctcactcacattaaattgtatcttttctacattagatgtcctcagcgccttatttctgctggacaatcgataaattaatcctgataggatgatagcagcagattaattactgagagtatgttaatgtgtcatccctcctatataacgtatttgcattttaatggagcaattctggagataatccctgaaggcaaaggaatgaatcttgagggtgagaaagccagaatcagtgtccagctgcagttgtgggagaaggtgatattatgtatgtctcagaagtgacaccatatgggcacctgcctactccacctatgtgttatgccagctttgatgaataatttttaaaaaccagaattattatttattgctgttcttttttagtgttattttagatttgttgattctctagagcaaaacctcaagccctttggggcaaaaacaaatggctaagcctaataagatgcatggtgctgaaaataagattaattatctaggatttgaattgaaattgtttttgagataaaatatgtccaaaatgtattattatgaaatgtttgtttgcagtgcttacagtatgccacactgaatgtagttcttattttcaagctgggaaggggagcaaataatatgatatctcaggagaggaaaaaaaaaatctcactttgtacccttttctaatccagaaggcctcagtttaactcaccatggtataccccattttagtcaaatgtttctttaagaggtctataagaaatatattaccagagtattttaaaaattttagcaagttcaactttctgagacatacgcacatagtcagcttttatacaaaagtgatatatttttagttccatgaaactagattattttcaagtaacgagatgatgccatttatcacagatacttaatgaaagagctgccaaatgctttattgccatagtgtgaatgcttaagttagtcatttattcaacaaatgttttacgaacacaaagtatacaccagaaactgtgaaaagtacaatgggaatgtgaaagttattaataaataaatatatctcatatgtctcatatatcatcaagccagatcagaggtttcagatacttttttttttttcctgcagaagacttctttttgaaactgcttccatttggtttcactgatctatttatcttttattacaccaataccacactttctcgattactgacattttgtaataagtcttaaaatcaggtagtgtaaatccttcaatattattctttgtcaagattttttgggtgtttcaagccgtttgcttttgtacctaaattttagaatcagcttgtcagtttctacaaaggaagcattctgtaatttttattaggatggcaatttggggacaattgacctcttaatgttgaatattccaatccatgaccatggtgtatttgtccatttaactagatcttacttaatttttctctgtaatatttcatattttttagcattgaggtctttgcagttttgttaattctttaaaaatattttatgctttttgatgctataattggcatttttaattttattttccagttgtttattgctaataaatagaaatacaacagattttcatatattgatcatgaatcctctggccttcccaattagttctagtagctaattctcaacatcttaggattctctatataaatagttgtgccatttgcaaataatggcagctttatttccttcttaaaaatctgtattgcttttatttcctttgctcaccttattgtgtggtctggaacatctagtacaatattgaatagaagcggtgaaccagatagcccttccttgtttctgatgttagggaaaaaatttttagtctttcattattcagtatgatgttaactataagtttttaaatagcctttacaggttaaggaagttccctttttttcccaggtagctgaaaggttttttgttgttgttgtattcataaatgggtgttaaattttgtcaaatgtttttctgtacttattgaggtgatcatataatattttttcttttatcctctccataacgtgaatggcattgattgctttttgaatgttgtaccaacttttcattcctgggctaaaccgtatttggttatgatttagtacccttttttatatgttactccataacatttgataatagtgtattaatgatttttcctatatttatgacagatattggtatacaattatttttcttgtgatgtctttgttaaatttgggtatcagggttatactggtctggtgaaataatctgcaaatatttccttctccgttattttctgaaacagtgtaagaacttttaaaatgtctgatagaattgaccagtgaaattctctagttcaaaagttcccttttggatttggtttgaaaattacaaattcaatgtctttaatagatacggggtaactagattttatatagcttcttgtgccagttctgtcaattttagaagaatttatcaattccatctatgatgttgaatttattgctacaaagttgttcctaaatgtttaaaggttctttagcaatgtctccattttcattcctgatatttcttccactttatttggtggtagttagaaattggtcaagcctgaataatgtataactatgaatgtatcctattttagtttccatagccagcacttcttaatctcaaggtatttatttctctctcccctctataatcactgctctgtctttcccgaattactacaaaaggcttaataccttttttgtgtataaactacttttattttatttactgatttttgttaccaataagaagcaatctattatcttgtacttgactccaaaaatacctaacacctttcaactctggtaaaatgcagtaatattcagattatttgaagaacaagtaagaaccaggtatcaatgtaaatgcttgacttaataatctagagttcaaggtttagatgtgttctaaaatcctgaggagtgaaacgttaaagtagctaagaagcataaaatctcagctggatttgaagatagtcccaaaccacattttaaaggtaaaaaattttgtaatcacacacacacacacacacacacacacacacacacacacacaaaatgcagaacatgtggtcaatatatgtcatccatagtgtcaacatcttaactggtctcattatactgtattttcacttggtcctttcttgtgtgtttctatttggtccttttaacacacagatttgtttcaacttagttttaaactatagtttatttattttttctttacttatcattgtatcataaacatgttttcaagtttctacatatttttctttgccttcactttaagtgatgacataatattcagtttagtggctgtaataacatataactatttccctactttgacccaatagatttttcctatttttcaattctctgaaacaaggctgagatgaacatattcatatatgtaacttttccccgtattttgtattacttaattagggtagatttatagaagtcagattataacctgaaattaaagaggaaagccatatatatttttataatttggctaaccacagagactttgtgatcatgaacttattggaattctttacatattgagtatggtgattagtattgttattatgggatctcaatttagcatacaaaaataaattattgagagctaaaggtaagacatattctggcagaaacataggaaaactccgagcacgccagagaccatggatgtataaggaacccagggataggtgaaggatgtggtgaaggaatggtggtgcaggcgtatgcagttaattccagtgaccagggtaaagtcatatagcatcttaagaagtcctacttctgaccaagcatggtggagcatgcctgtaatcccagcactttgggaggccgaggcaggcggatcaccttaggtcaggatttcaagaccaacctggccaacatggtgaaaccctgtctctactaaaaatacaaaaattagccggatgtggtggcttgcacctgtaatcccagctactcaggaggctgaggcaggagaattgcttggacccgggaggtgaaggttgcagtgagctgagatcgcaccactgcaccccagcctgggcgacagagtaagactccatctcaaacaaacaaacaaacaaacaaacaaaaaagaagtcctacttctgagagatctgagacacatccacgggaaagcccttgttccatagaaaagtcattttaaatattaagttttctataagaaatcaaggctgcaaataatatgattggttctaaggttgttgtgcaatacattgtgctgtattcagagggaatcatggccagtatttcataagaaatgctcacctcaaagagagtgttctatgattacctaaaccttaggatagcggccttcatgcttgaaagagttaaagggtctttcagcttcttcctcagcatacagtttaattgttatatgaaagtagcaactttcattttttaataagaggagaaaacttgatcatcatgcttgaaaattttgtgaaaacagttcaagtgtatatgctgtgataccattgtctagcccctcccaaagccattacatattttaatattttatttttactgattgaaaggtcttgggatcaaggatgagggaatacagaaaatagaatatgaaataatttcttaagataattctgatttcgaatagacctattattactattattatttcaaataaataatagtgaacacctctccttatatttccctgtgtgtcagcttgtacaccattctttctaacttacgttttatcagttagacattgcaaacttttaatgaccagattttgtctcccccaccaccaactggcactgcagttcacgacagttgatgtgccacgtttaatttttgccggtttttaaaatgaagtttgagcgtgatgttgtgtagaaatgtcagagctactgacttgtcagcctcattatgctgtgccccagtgactgcttcccaaacattaattacattgcacagagaccatgtctattgtttttagttttttttcccttaaactgtgaactctaaattgatttataaatcaaatgcagctgattagtgtttataatgttttcttaaatgcactttgaggtacaggttacatattatataaaacactgaccccactgccaaaagataacccacacctagttgattttctgtgacaagtagtttgtaaatgattaccgctcatgctacatttgtcagcttatgtgtattccgatgtcaggataccctaaagatataaatgactacttatcgctcaacatagtggatattacccatgtgttagtcatacttgcctgggaataagtgctttaaggtgacactgcatcaaagaaagttatagtgggcctagagggtgattcaaagatctgtgtctttgtatttttaaataaatttagcaagattgaaggatcaggtgctctgcttaatcaaagagtatgctttgcatcacttccaaggagtaagaatttagtgaactatagttaaatgtaaaactacagtgaatggattatagtctttctttgaatcttcagaaggcacttccagtttgtgctgttaagcagggtcatcattagcaataattattagagtattggctgaatccccagtcaatagatatttcttgatgacagaatgccagaacactgagggttgactgtaattcatatgctttgttgacgacgaaagggtcagagttagttacttcggacatttttaacctttgatatttgaaacaaacaccaaataggactcagtgaacaagaaaattcaagaaataccaattcttgtttagcaacttgaagccagaagcttctccagcactcctacaatgttggcagagtgggaaggagccctagctttgtatcagtgaaacctattagaggaattttatatataaggacatgaatactacaattaataggaaattccaaattcttattctattcaatagtgttaatcacatgttccagctaccagtgatataacactgattctatccaaggctgaggaggagagagaatttatcattgttagcttctatctagaaatgagctcaattctcttcacttaatgttaaatccacagaagccattccataaagatttaggccaattctgtctctgccctgaaggtcaaagaatcaggctcagtaagaactcaaccccataaaatcagtgattgctggaatcactttgactttgggagaacaaaggaaagcactctccagtcagaagatatcttccttaatggtctactatgggacctaaaagttcaaaactaaaaattaatacctttagacaaagacgctgaatttccagatgacctctgtaaaaaattaacttgttctgggagagataacccgtttcgtcccaattagtcattaatcattaatcatcttgaataaagtgttgacaggtagacatctagaaaagacatgagagaaaaggatgtagacagatcaagtaaccttggatgaaagagaagaatagatttggagtggtaataaagggaaggcactatactagaatattttattcagtctggaagcaacaagaagccactgataattctgaagaggtaagagaaagggatttcttgtatgtgtatgtatatgcgtgcacacacatgcatacatgcatgattgtgagagagactgaaggtggtgatatcagacaaaaccttttctggttattggttataacctatgataattagtaaattattattgaatagcattgttatttactttttattattggaaattccttcttttattttaatgtgattatatatctgtccttcaaatcttcatatcacttattgcccgggcacagtggttcatgcttgtaatctttgggaggcggaggcaggcagatcacttgaggacaggagttcgagaccagcctggccaacatagcgaaaccccgtctctactaaaaatacaaaaaattagctgggcatggtggcacatgcctgtaatcccagctactcaggaggctgaggcacaagaattgctttagcctgggagactgaggttgcagtgaacccagattataccactgcactccagcctgggtgacagagcaagactctgtctcaaaaaacaaacaacaacaaaaaaacttcatatcacttcttgcatacactatccttttgtcaaaattttgttacggtttcaggagtctgattcagtgagggcctattatgtgttggccaagtttgggttggtcactttctctaccagatcaacttattcatgattcaagaaatgtgtctatatatggtatacttcaagcagcgtgctagtcactttatttacttccaagatatatggaattaagtaagctacttattctctctaagcctctgttttctcaccaacaataggaagaagaggatgataatgttaatgatcgcaacaatggcagcgaacaatgaggaagtgagtgcttattgtgtgctccacactagagtaggaacttaacatagattactttaaaatagtatgtgtatttctttttcattgcaatgttagaatgtgttcattgtctaaaaaaaaaagacagtaaaaagagaacaataaaaaaactacctttagtgccaccatctaataatctacctaagaattctactatctgaccattgttaatactttggtgatatatgtactttcaaactttttgctacaaaagacatacaacatgtgtttttgttaattctcacatcaacattgcaaggtagatattgttattctagaagaggaaacatgaggttaagtgaatggaggaactggtagtagaaccgagctcactctggactcaaaagatttctccaatattctgcttctcattcttctgtaatagaagtgtttagggactgatactccttttagccaactaaacatctgcaattagaatgaagtaaaaaatatttcttccctcatacaaaccaacttcctagtaggagtcattggcatgtaaggcaagatttactaaatgaataagattgagaatatcaactggaggaccaagtcatctgaaatgacagtgatatttctaaaataaaaggcccatgtctctcacaaagttcacctctcacttaaatatgaggttttcattctaagttagtatttttcctgagagtgtctattgagctggtagcaaaggttcttgtagcagcaaagtaaattttatatcattaaaaatctacagagatgtcttcttcaaataccccatggtgccctgctctctggcatctcccttccctgctggataagaggtagacactcttgcgaagattagatcttttgggctaaactagggtcagctggaggggttggtttacaaccccctagggtaaaaagtgcaaagatattattctgcataggagaacttagttgcttttgtggaacatttttagttcacttggttgcttcctgtttttgctttttttttttttttttttttcacattttcttttatgtattaagatgcatagtggagtctaatttcaaaaactacttagtacatttttttagagttaactctggaaaagttagcacgtagatgcacaacactttaccttttcgggcaatacttccattgttttacacgtagagaaaatgggcttctaatgagagagagaagcttaaagaaaaaaaaatgcttaaaatggtatgaacccagtattcaccttagacaaaatcacgctaccacacgctgctatgtctggggcagacattctctcatttcctgcattttttttttttttttttttttttattatactctaagttttagggtacatgtgcacgttgtgcaggttagttacatatgtatacatgtgccatgctggtgcgctgcacctgtttttgcttttattttctttcccagaggttattttcattctctgaaattataaaaccatattctccaaccagggataaacctaagactcaatggcatctccactttccctgggctgatagggaatctagatgacaacctagagtccttcttcacagtagataatctggagagtttgtacccacaaatgggtcaaacatattgcattcagtgttccattaagtcatgccaagtccacgctcccatgggtttagatttcaaaagaaagggctaggaggttgtgcatttcctggcatggggtatacctcttagtggaatgaaagacactttgcagacaaaaagctggcatgaaacatacctttgattccaccaacaagcatgccatatgtcacaaaattctactgcttcctccctgttatttcatctgagtgcctctttcctgcacatggctctcgggtgcagttaagtaaaatggatagtacatttaattgatgtaactaacttgaattcagttgggcttaagttagttatttgataaatgggtagtatctagagtttgatactctttatgggaggcaacatgatatagtgaaaagagtgccagaataggagtaataaaaccggggtttttgcccaaggtctgctattgccttgctttgtgacctttggcaaatatctgagcctctgttttctcatctgaaagtcagagtaataatatttttctgatctgctatgtcagcggggtatcaggcatataaattataatattgtgtgtgaaagttcaatattggaaaaagtctaaagtgctttgcaaagtacaaggtactattaatatatactttctaatgaatggctgaataccacacatctatatgaacatggataggaagaacagagcggaaagtacaaatttcaaattttccatccaaaacttttataattgctattttatgataaaaaacaatacatcttcaatgtggagaataggaaaaatgtaaagaaaataaaaatcattcataatcacccaacacaaagattattgctatttaaatattttggtgcatttctcttcagtattttttttcaaatgattggcaataagccctgtctgtgagggatttttctatttttctgatcacaaattctaaacagtttattatagagaatttaatagaaagttaaccccttcttcctatgaaactaatattaacattttttcatttttaaatttagtttcattattaaatacataattttcattattaaatttatcatattttttatttaaaattgttttctagtgttttcctacatcatcagatactatccaaaactattttaactttttattttctatattttaaaatatacaagtggcccttggcttatgacctttaaacttacatttttcagctttacaatgggtttatcagggtattaaatgcattttcgacttatggtatttttgacagatgatgggtttatcgtgagttaaccccattatatgttaaagagcatctgtataccaaagtaaagcacacaattagatgaacccagcgcttatcagtcatataacttggatgattttcaactcataaaccatattgctgcacctacaagccactcaactcccctttctttcctccatgacttttttttattattaaagatggggtcttgctatcttggccaggctggtctcaaactcctggcttcaagcgatccttccatcttggcatcccaaagtgctaggattataagtgtgagccaccaagcccagcctcttccatgaatttttgaagtaaatccaagatataatttcatccataaaactttagcatgtgataacaaggtataaaaactttctttaacctaactacaataccatattgcacattaaaaatgaacaataaatctttaatatctttagatatcctgtacattcccatttccccaaatgatctcataaatatgtgtatagtattttcatttctttgttgaaatgaaaacccaaagaagatgcacacattacaatttgttagtatgtctcttaaatctcttttatgatcctcatatttcccttccttcttttattttttcttttcaattatttgtttaaaaactcggccattttttcctatggattttctcacattctgtattttgctatttctatccccactgcattatttgatatgtttctccatctccagtacttcctgtaagctggctatgagacctagtttactgctgcctaatggaaatacaatctgagacctatatgtaatttaaaattttctagaagtcacatgaaattaatttaaaaaatatattttacttaacagaatattcaaaatattataacaatatataatcaaaataaaattattaatgaaacattttacatttttttactaagtctttgaaatcttaagcaaaaaaatccccaatgtatagcacttctataaaatcctgccattaaaacatcagttatttgggcagaacttctgactgtagtctaatgagataatctacaatgaccttccccaaaacaattatgaagctcaacgaattgacaaaaacgacacttaagtacccggaaatcaaccaaaggcctacaacaatccaagaagcatttgtatttcaataaactattggactgtgggtaataaaagtgggaatctatgatgattaggcctgggactgctcatgatccccaccttcaactctgagcttggccaatgccaaggttctgctgtggtggggcaggctgtaagaattgtagctgcattggcatggttgaaaatggttcacttgtgaagaggtgaatgatgcccacacccagtgccattgttggtagatgttacagtctcaaacttgggccggtggggaaggctagcagttctgctaacctgaggttgtggttgtgactgggaaaagcatgtttctgactgaggctgagcttatgtgcagcagacaatggagaactacctgagagggcttaagccagccacacactgctagtcaacacagtggagacatgaaaagccctgtggataataaaagctgcagggcaaatatgaagatggcatcaacattgagtgagctctcattcccacacacagatccattgtcggagaatagaacacatacctgctcaagatgggtgagcacaacctctgcgcaatcattgaccagccacaatgctacaaggacacaggagtgacccgtaggaaaccagacttaaaaagaatgtgacagaaaaattgacaaaggaaatcagcagctacataccatagagtgacatatttcacagatatagcccaggcaagtgactacataaagaaactaatggacaaaatgtaacaataaccttcagggagaaaaaatcagaatccagagctgctatactatattatctaaaatgtccagttttcaacattaaaaaacactatgatatatgcaaataaacagaagagtataactcatcctcagtaaaaccacaaaaaagtcaatataaactgtcgctgagtgtctccagcttttgcaattagcagacaaatcttcaaagcaactattatacatatgttcagactagtaaaataaaccatcaataaaggcttaatggaaagtatgacaaaaatgaccaaattgttgattttcaagaaagaagtagaaattatgaaaagacttaactggaaattctaggattcaaaagtatcataatttaaatgaaaaattcactagagagactcaaaagcagatcgaatatggcaaaagagacaatcagctgacttgaagattgatctgtagatattatccaatctgaaaaacagagaggaaaaagatctctctctctctctctctctctctctctctctctctctctctctctctctctctcacacacacacacacacacacacacacactaaacagagcctcaaagatgtgtgggacaacatcaagcatatcaacacatgcataatgtgagtcccagaaggtgacagagaaaggggcagaataacacaacatgtaaaaaggaatatattcagaaatttaaaaggacatgaaatactgatacacactacaatatggataaacctcaagagcattgtgaaagaagccaagtggaagagaccatatattgtatgacttaatttaatttacagaaaatgtccataacaggcagattcatagagacagaaagtagattagtggtcgccaggggttgggaaagaagggatattgggaatgactgcttactagatttaggaattatttttagggtgatggaaatgtttcaaatatggatggtggtaacggtttcacaactctgtaaatgaaccccgaatcattgaattttacacttaaaatgggtgaattgtatttatgaaaattaaactcaataatgctatttagaaaaacaaacagtaaacatatcaacaacaaaaacaaagcaacaagttcagtaatttgatctagtacttagttattctggtatggcccacaacatctggcataaacattgactccctgaatgatattttctcaaaacaacagacagcctagttttgatacatttacaatcacaaaaggtattagtaatcataactgtataaaatgccttacggtttacatggccttttcatgtgtattcttttatttgagtcatctgccagcactctgagggagaaagggcatttaatctttagtatgaaaaaggaagggaagttaactgatttatccaatggcatacagtacgtgacacaatgggcccaagctcagacttcctgactccaagttcaatgtcctttctgctacattatgccaaccctactctctatggtagcaacccatttgcaattacattgtactatgccatgtaggtgaatatgaaaatatggatattagaagagggaatcacaaaggagaaaattacagttctatttgtgctatgttcttcctgaatatttgctggtagggaggctgaggaagtcagcaaatttcctgcttgtggcctggaatggcgtggagatctgtatcaaactgattacacattgacccaacaacatcaagtcaattctagccctctttcatctggttatgtagtaagtgagaaatagggtaggtagggggaattgtgttatagactgacacctaataaccttgcagagcagccatgtcttcatagcttttctggtttcattcatagcatcttaggatcttaggatgctatgaatgaaactggatatagattcccttttttctgggcctcgttatgccattcttatccaagaagcttattttctttgttatataagcaaggccaaatactttttcagatgctctgtaggatctaaagtcttcttagtctctttccaaactgcacctgaaagtcttacttgagtttcctacagtgattcctccagcttcctttgaaccttatttcagagattctgtgactgccacatagcaaagaaattaagagtacaggctctggagccagaactttcggatttaaattctagctccactagctgtgtgatcttggtgaaattagttaacctctctgtgcttctgtttcctcatctgtaaaataaggaaacatattataacatttttgaggattaaatgtgattatggatgaaagttgcttaaaagagtacctgtatcttctttctagttcttttaattttgataaaaataatgattagttataattaatattaactaagtatagtattaaataatattactaattattatttgtagtagtatttaagaaagctgacaactttaacctataccagaagttttcctctggtacttgtattttttaaaacttccagtctaattattctcatgtgctagccatgacaaccctgtgagattcataaaaataatgatagtaggtatttccccactttacagatatgaaataaaggaatgctattttgtcataaagttgggtctagagcttccttttagaacccttatatacagatctttctaatacagtctgctgcctttggcatagttatcatttgcccaccacagcaaaatatttggtacaagtcccgacaatcattgttaacctctgtatccacctctgcgattaagtcactaaagggtgtgtatctttgttgaatatgttatgttaatttgattagctccttttcagtctagtctttagcataattgaaaatgagtctccagtagtaagcagtagaaatgctactgcttccagttgttatacatgaaacttgaggaggttacagatacagtgttgatttcactaagctaatgctgaagacgaatggcagtagaaagctatgattaatacttgctatttggaaactctagaagaaagttatatctttggttgtataagaccatatttaaagcctattacttttcaagatactgtattaaatttgatattacattttgcataagtactttaatgctaaaattactataaaatttacaaaaccccaatggatttcattgtagaaaaatgaattgaatatgattgtttatttgtggaaataagcagctattgttcttctctaaagagtaaaaaagcttttatacatcgagttaccttcagtttccttgaagattgtttcctatatgaagtgtttaggtgatctacataatccaccacaaaggatattgagaagtaataagaaaaagataatttgaaattactttagaaggtgctggagttccaaaagaaagggtgtgatggagatggatattactgcaactcagaactgtatattatttgcaaattactaagggatagaaatatgctaggtatttacaccgttacaaaaaatttctgctccaatgaatttgagatatgaaccagagttcctgggcccgcattttgggaggcactaagctgttgccatttatctaatgggatcatatgaaatactcaataaatcttcaaaattattttatatatatatatagtgtcagtccctgagaattttgttcagacgtgtgtgtgtggtatctatggggtacatttggagtcaagattccctaagcagcaatggtaaatactaaatgagagtaagcctccaaaataatttgtgttagagcttctttatggaaatcagtggcaccaccaacttttccattcactaattttttacctctccacttgtctcatgtgatccaacattggtgtccatgaaaagttttgaggctttaacaaaaataatgagaaaaataaagacacattcattcagaaaaatcaagaatctacaaaaagagatgtgagatcatcgctatttaattgtagaattaagcaacttccatgtttctcttttaaagtgtcctaaagagcctgccaaaacaccttgaggatatggactgcaggtgtttttgcaattgagtcaaatcagttttgaaggaatatttttgcaggatggaccttttattattccattgtaatagttttaaaatgttaatagaacaggtagattaaacaaatacatgtaaactaatgccattgttatggtttgaatgtgtcctccaaagtttatgtgttggaaacttaatgtccaaagtaacagtgttgagaggtgggaacttcaacagatgaataggaaatgagggctctgctgccatcaatggattaatgccattatgatgagcgtgggttcattatcaagagagtgggtctgttgtaaaagcaactttgatgccttcttgctctcttatgctttcttgctttattattattagtagtagtagtggtagtattattatactttgagttctgggatacatgtgcagaacattcaggtttgctacataggtatacatgtgccatggtggcacccatcaactcatcatctacatcaggtatttccctcccctattctcccactcccccgacaggtcccagtgtgtgatgttcccctccctgtgtccatgtgttctcattgtccaattcccacttatgagtgagaacacgcagtgtttggttatctgttcctgtgttagtttgctgagaatgatggtttccagcttcatccatgtccctgcaaaggacatgaactcatccttttttatgataagcaacttcagcaacgtctcaggatacaaaatcaatgtgcaaaaatcacaagcattcctatatgccaataatagagagccaaatcatgagagatctcccattcacaattgctacaaagagaataaaatacctaggaatacaacttacaagggatgtgaaggacctcttcaaggagaattacaaaccactgctcaaggaaataagagaggacacaaacaaatggaaaaacattccatgctcatggatacgaagaatcaatgtcatggaaatggccataccgcccaaagtaatttagagattcagtgctatccccatcaagctaccattgactttcttcacagaattagaaaaaaactactttaaatttcttatggaaccaaaaaagatcccgtatagccaagacaatcctaagcaaaaagacaaaactggaggtatcatgctacctgacttcaaactatactacaaggctacagtatccaaaacagcatggtactggtaccaaaacaaatatatagaccaatggaacagaacagagacctcagaaataatgctacacatctacaaccatctgatctttgacaaacctgacaaaaacaagcagtggggaaacgattccctatttaataaatggtattgggaaaactggctagccataggcagaaaactgaaactggaccccttccttacaccttatacaaaaattaactcaagatggctttcttgctttcctaccttctatcatgaattgacacagcaagaaagctctaactagttgtgtccccttgacctggactttccagtgtccagaactgtaagaaataaatctcttttctttataaattagcccgtctcaggtattctgttatatcaacacaaaacaaactaagatggcacaaaacaaactaagatagcagtaaataatttcagttcaactcttgagtgttatctctttgacataatagaatgtctatgtaccatgcaagcagtctactttgaaagccatcattttctggagaagaagtcccatattcagtacataaaattctcagcccatctcctaaaaagtggtgatttacttctctttttatatactaaaatgttatggctgtttccacgtgaaaccaaaagaactgaccaattccatgataaaatcagactagtcctttaagctttatatgcttatgtaagctgtcatcacacacaaactgatgtgttctttttcagtgttagaattcaatcaaactataattcattttctgactaactaaatgaagtcaatcaagcagccactgaataattagactaacaaattgtttttggaaaaactcttggttttacaaagttttgtcatatttttctaaagcaacttgtttatgtccagttggtgaccatgttttccttttagagtaacattcatcaacaaaaagaacaaaaatgaaaatggcaaacagactgtgaaagatagtttcaacaaatactatgcataaagggttaatatacttgttttatggcatcaatatgatttaatttttttttttttcgagatggagtcttgctctgtcacctaggctgaagtgcagtggcacgatcttgtctcactgcaacctatgcctcccaggttcaagcaattctcctgcctcagcatcccgaatagctgggattacaggagcccaccaagacacctggctactttgtgtatttttagtagagacggggtttcaccatgttggccaggctgttctcatactcctgacctcgtgatctgcccgcctaggcctctcaaagtgctgggattacaggcgttagccaccacgcctagcccgatttaatttttttaaaactcaggttctcaataggtaaatgtgcaaaagccccataaatagacagttaataagcaaggaaatataactagcaaactcgtacagaaaaagtattcagcctcactaataaggaaattcaaactaaaagcacaattaatttacttattttaaatagacattaaaaataatactcaaagttgacaagggtacaatgaaagaagagagtgttcccacacattgctaatggcagtgtaaatcattacaatcccctaaatccacaaaaatgttcaaagcttttggctcattaattcaacttcttggaatttactgtaaggaaataataataaaaaaattgaagatgttcatggtatctttatatggcttcagttataatacttgtaaatggtgagggaggagtgtaaatagccaacaattggggaatgcatatgtaaattactgtgccttcactctacccagccactaaaaatgattgttacagatattgtgtagaagcatgcaaaaaatcatctagcgcgaaggaagcaacatgaagaaatttgtgtgcatattatgactgaagggaaatggaccagaatgacagtagtcactcttacaggctggtaggattatgggggagattaggtgattatgtacttttttttattattattatactttaagttgtagggtacatgtgcacaacgtgcaggtttgttgcatatgtatacatgtgccatgttggtgtgctgcacccattaacccgtcatttacattaggtatatctcctaatgctatccctcccccctccccccaccccacaacaggccccagtgtgtgatgttccccttcctgtgtccaagtgtactcattgttcaattcccacctatgagtgagaacatgcggtgtttggttttctgtccttgtgatagtttgctgagaatgatggtttccagcttcatccatgtccctacaaaggacatgaactcatccttttttatggctgcatagtattccatggtatatatgtgccacattttcttaatccagtgtatcattgttggacatttgggttggttccaagtctttgctattgtgaatagtgccgccatgaacatacgtgtgcatgtgtctttatagcagcatgatttataatcctttgggtacatacccagtaatgggatggctgggtcaaatggtatttctagtgctagatccttgaggaatcaccacactgtcttccacaatggttgaactagtttacagtcccaccaacagtgtaaaagcgttcctatttctccacatcctctccagcacctgttgtttgtacttttatagcttttattttctcacacccacagcagttcacttcttaagtgctttcttagaaaaacaaagaaagttaagaggagaatcagtcagaatttcacctttcttttaagagcttcctaaatacagtgttttctgaatcagtcaatctgcattaatgtaataagtccttattaaggaaaaattattgtaataattccaaagagtactatcctcctttgccagctattcctcaggcactgtgtggcctcatttcctctatctgttgtgctatgaaggcctggtatccttaggcaatgttctatgtaccctttaatttatttttctgaggtggagtgagactatttggaggaagttccaaactataagcatctgctgtgagtaggaccagactgtattttctgagggtaaaccaggaaacaggttcccattttgagggggcagtgtatgtgattaagaatgagaaacggaaagaaaataaaaggatagtggaggaaaggttatccccagtgcatagatatatactcaggtccatggattcaaaacaatattttagttcagctatgctacagtagattggagtatgtgtgagaaggctagggatagggagaggaggacaaaggaagaaagggaagaggagaaggaatgataactaatgtaaacatggtctttatactcatcattttattttttgcaaatcaatctaaacttcccttcacatttcataaacaattgtagaattttagagttggaagagttctttgagataatccaatctccttagtttacatttagaaaaagaatgccctgagaaaggggaggtgattttcctaagatcattctgccacatgttctgaagagcagtgtagacgagtggttaagagtcgggccattggagacagactgtaggaattgaaatctcagtcctgccgtttactacatgtgtgatcttggcaagaaacttaacttctctgttccttggttttctttatctgcaaaatgggcatttaaaacagtacctacctcacagggtgctacaagaattaaatgagttaatgtaggaaaagcactaatatagcacctggtacctgataactgctttatgagttagctgctacagctgctgctgctgttacttttattgtgataattctgtcagttgaaggtcaatgatttccacatactaagttgtctctccctaaccttacagtgactaaataaatgaacataagtctccatggctgtcttctaaagtcacttagagtttgtcttgttagcaagtagagagtttaaagcacaagagcaagccacagatgttgacatttgaattcatactttgtggactatctgaaggcatcttctgcagtaaaaactataattgacttctttgttttgcactctgttccatagcagcatgtgttttccatacacatttgctttgtcttagagtttatcattatcaaaataatatagaaatgatattatttggatgtgaatagcattttatatatatttgatttttctgtaagttgacagtttcatcatcatgtctaaataacatttacttgacagtggacccccaggatgccatgatgggcactgactgaaaaagtcaattaagcacatgggaacctatcctttaccatagagtatttggaacaacattctttcagaattattatgctttcaaccattggtggatttaaaatattaatctttttcttaatgttttctgcttttttattttgaaaaaaatgagctatttattagtgaattcaaactctgtttctcaagcctttgacaaatatcacagttatgatttcacaactctaggcacacataattgtgtgcacctccatatcacatgctttgagagacctggaaagttttccttgtcacctgggtccactgacacaaattttaggacaaaaagttatcgttgagtgtcgaggagcaggaaaggattattttctcttagtttatactacttttgtggtttgaaggaagagtgcttccaagggcactcaataaccttgaatagatatgacattcctagctgattcatggctatgaatagttatgattggaaatttgaaagggtttccagatggctataggaaagtctctctctctttctctctctctcgttacaaataaacctatggagggaaaagagaatgcctaggtttccatgcataaaattaagggtgattttaacatgataaatcatatttgccaaaacacaacattcagcattcaaagtgagacatttttcttttttaaatttaaatcgttaggtttgagtggcattaagattagtagagattcataatcaactgaagtttaagttgaaatgaagttaagttaataaagcttaagttgaaatgaattcgttgaaatgaagttaggtgaattatttttaccttttaattttatttttgtattttaattaatagatttaattttttggtgttgttttactttaacagaaaaactaagcacgtttttcaaagtttctgtatatatgttttatcccactcagcaaccatttttatttacctaaactctactttgagtatttaatattcttgagcagcttagaaatttgagactatctttgtatatttttaataatgcaactacccttgtcaaatttattttcccttgttgtttccagtatctagtccactaatacatttcttttatagttcagctctcacagccactgaagaactttacattggtcattgtgatgatgaccctagtggcagtgtggaggatgggttggagcaggaagggtatgggggaaggaacatctacagttcaggcagaactgatgagggactgagctaaagcagtggcaactgggatggaaaggaagagagagactggagattgcaatgcgacctagcaattagctagatgcttgtgtggatggaggagtggtaagttctaggtttctgacttgaactactaatgtggccattaacagagatggggaagtttgagaacatgaacacattttgggagggaggaaatactgacttgccatacctaagggaccttcgagtaaagctgcccactttacagttgaaataggtgcacatagcttaagaaagctctcggggctagattaaagctgtatgaatcatcggcgttccatgaaaagaaaagacgtggctggatatgggatggaccggggaagctgtggcatttgtagaaaggaaagacctgtttagacgttaggtgaattttatagatgcttccttttctgggtgaaagtctaatccttggctgtaaaactacatctctggaagcctgctattggtacagttctcaatttgcactgtttgtagcaaagtaagacaactgtccacctttcttcttaggtttccatagcatctcctgaagatcatgttatggaaacctaagaagaaagagattaaaactggtgttatagatgctcaatggaatttcaatggttgtggtgacaactagttgaatcaagtgcaatccttttccaatatcttcatctttagtgctcaaacattactgtttttgtcttttgtgtatacaagccacttcattctgctttgtagtagagttgtttacttattgtgtatattaagctatgagttcctcaggggccgagactatgtcttatgcatttccacgttctctccagcccctcttgagagttttcaacagttgtttatttattcattcaacatgtattgaccaagtctctactatatgcaaggtactatgctttttctgaatcatatagcaatgaatagaagagataaaaatgcctcccttcatggagcttatgttttagtgggcagagacagatggcagatgataagcaaataaataaaaaatatatagtgtgtaatttggtaataagttctttgaaagacaagaagaaagacgagacgtaccattttttggtttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagatggggtttcaccgtgttagccaggatggtctcgatctcctgacctcgtgatccgcccgcctcggcctcccaaagtgctgggattacaggcgtgagtttttggtatttttttatgggaggttgcaaaggctgtgaggcacaaatatgcctggtgttttcacaaacagcaagagggttagtgcagctagggtacatgagcaaaggtagagtagggtacatgcttctgagcaaaggagagacgtgatatgacttagttttattctggctgcggtgtggagggcagtaatgtaagaaggaaaccaattaggaaacaattgcaataatccaggagggatatgatggcttgaactgatgtggtagtgggaaattgaagagatctggttggattctggatacctttcaaaggcaagaccaacaggatttactgatggattgcatgtgggatgtgaaaaacaggagtcaaaaatgacttcaagttctttggcctgagcaaacagaagagccttgtggccatctattaatatcaatataaagaatattatggaaggattaggtttggaaaggggtgggaattaagagctcacttttgaacatactgtgtttgacgtatcttttagatacccaagtacagatattgagtaggcagttggatattcaaagttgtggctcagggtcaagacccatgctgaagctataaactgagaagttatgggtgtgtagacagtatatgaagccaatatactggcgtgagattagattgttgttgaatcattggtgtgtgtatatatatatatatgtatatgttcatatctgctgctttctctttaagcatgctcatctctcatattagttcaaaccaaactaggtgtctccatacacagtttgtaggttcaggagttaaatagtttctactacgtgtgtgcctaaagtaatacttagcggtgtgggggatataaagagacattaagactcacatcctgccttcaagaccttcacatttgattaggaaaagaagaccttgacttgtgaaactgttcataccacaaaagaagaaccatttaaaacatatatcagtcaaatgtgtaagccttttttaaaaaatcagcctacataggccgggcgtggtgcctcacgcctgtaatcccagcactttgggaggccgaggcgggtggatcacgaggtgaggagatcgagaccatcctggctaacttggtgaaatcccgtctctactaaaaatacaaaaaaaattagccgggcatggtggcgggtgcctgtagtcctagctactcgggaggctgaggcagaagaatggcgtgaacccgggagacggagcttgcagtgagccgagatcgcaccactgaactccagcctgggcgactgagcaagactccgtctctaaatcaatcaatcaatcaatcaatcaaattgatcaataaaaatcagcctacatcatactttgaaaagctaaaagccttttttgaatgatttctgtgttctatgtgcttggcataaatgcaataagaattccaaaatatgagatagtgtacatgatagaggagccaccatttggatgtctatagatttctttgaaaatacatatggtgaagagctgaagaaaaataaaagagtcagtttcactgcaaaataaaatcataaagttaattggtttctaactacatttttaaacattgtatgaaaagaccaagttgcaaagttgcaacagtggactgaaatggtgatgacaaaataatgtaaagaatgaaaataagaacatttttacagggcttttaaatttacagaggactttgacatctcagatgacacttgatcgtctcgaaactctccgtgctaagtagagcagttaatgcctctactggccctaagaccttcagtggctcctagctcagcattctatggggaaagggggttctttcggtgatttatcatgaagtttaaaattgctatttccaaaactgatttagatcctgctgttgctgtaccagtatactcaccagaagtgtttacatcctctcagtactatgaagaacaaaaatttaccaccacctaactcattaagaatgctctgcaggcctgaggctcaaaagccacaatatgagcacaaagagttcagtccccctcaaggatactttattccatgagctctctcactcagaatccttcccttactcagagcccctgtcttaaatgtaatattaaaccagaagcaagaatgtgttctttctgaatgtagttctcttaccagttttcatttcaaatgtggaatgtgcagggttaatctttgtactcctcaccactttcaaatctgataacgttttttaatctaaccactgattttaacattaaaaacacgcacacaccatagaacaacgttgtcctctatttgaattccaatacaaatatttttgaaggctgtctctcttttaccttgagtattttctgatgctgcaacctccagcttaatccttaatgcttgacaatgtatgcatgtaacacagagtgttattattgcctccggctagcttcatgtcatctagtttgtcttttacttctctcctttgatggtattatcaggaccaattgtgaatctgccagatgcatttcctcacaaaaagataaatctaagaaggcttgtgtttttccctttctcttccaggactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaaggtatgtttttattggatctttataacaaatattatttctcattagagaatgcttgtgtgcataaactttgtttcaaaaataaatttgctaatgttaactggttaataattcgcactgcttatatatgctcagagaatctattgcatatgtcagcccagctgaggttgtaggttacatgtgctttttatggattatgcatgaatttggatgctgcagtcctcttatcagagcattcaaaatttgtgtaatcctacaaatagccatttatagactgaaggataaataatttatagtaagatgaaaagtaaacagctaagtgcttttcaagccattgcttatatgggacagaagtctcaaataaatatttggctgctgacaaagctagcaggttagtggagaccaccaaacagggttccagaaagtctatcaccgtaatgtagaaacattgtgtagccgagtctgaaaggaaagtaagaattttttagaacccttcctacaatagccatattttggagcatattctttgggcagtcttagtttctcaattatggattgacaagacagtttctaacaaaaaactagtagaaatacgatttcctgttccaattgatagataaactgtgttagacactattttaatgacgtagaagatactgacattggcacaaggttttttgtttttttgttttgttttgttttgttttgttttgtcttgttttgagacagaatctcactctgttgcccagtctggagtgcagtggcgcaatctcggcttactgcaacctccacctcccaggttcaagcgattgtcctgcctcagccacctgagtagctgggattacaggtgcgcctcaccacactcagctacgttttgtatttttagtggagatggggtttcaccatgttggtcaggctggtctcaaactcctgacctcgtgatccacccgcctcagcctccgaaaatgctgggattataggcatgagccaccgcgcccggatggcacaagttatcttttttatgaataagttaatgctgagataaaaagtaatagacttaattttctatgtcctccaagtgtggacttgactagcaacaacagcaaaacctgagaatttttttagagtgtaaattctccagccccactctagacatattgagtcagaaaccctgggggtgggacccatttgtggtttaacaaatccccaggggattctgattcctgctcaagattgaagattactgcttgaaccccgaaatatttttactcagatggcttcaatgatcacatctatttgagtgaccttcaaatatttatcttcagacctaacctccttcctaaactctagtcctaaattttcagttaacctccccggcatttccaaatgaataatacactgacacctctaaaccagtctatttaaagtggaagcaatcatcttaacactcctaatcccactcatcttccttgtatcacctacatctgttaatgatgctcccattctcccaaccacacatacttactatatctaatcagtttcctcatccagcagagttaatctctacatctctcaaatccattttctcctttccattttcatgatcattactctcattatatctcacctagactgttttttgtttctttactggtctaccgggatctcacctcatctcttttcaatccctttgctgtgctgttacatctttcttgggatacaatttgctgctatctctctttatgcatattcaaccatctttcaaggcctagcttacaagcatcctttcccactgaatccttgcctcaccatcacccccaacatcatcactgtttcactgtgtaggtgatcttcctctgtgaactttgaaaatacattctttttacttttttttttctgacagagtcttactctgttgcccaggctggaatgcagtggcatgatcttggctcactgcaacctctgcctcgtaggctcaagtgattctcgtgccttagcctcccgagtagctgggatttcaggtacgcgcctccatgcctggctaatgtttttgtatttttagtagagatggggtttcaccatattggccaggctggtctcgaactcctggcctcatgtgatctgcccgcctcggcctcccaaagtgctgggattgcaggcataagccaccatgcccggcctctttttaacctcttcttatggttatatatattctcctagactgtatactcaataaagatggggatcatgacagatctctattttccataaaattttgcatataatatatgctttataattgtttcatttaaggaattagttgctatcaactgaaatataagtgcttatcatgcattgaaaactattctttaaatattgccatgtcaaatgcaattattacaaatgaaaattacagtactctaattagtactggaatcttacattttaaaaacaaccttaaattgagccaaaatttaagatattcattctaacaaatatacattaaatatttgtgatgttaactatattactcattttcatcccttaacgtaattggtaaaagttttatatctttcttttcaaggaattcattttaatatttcccatttttttcagttaatatcatgtaagttcgttctaaaataattctcttcttctgcctgacaattgggaaattatttcctatggaaatgtttttggctttaggaaatgcctagttctcattaaaatacttatctgtaagtttgtctttacagaagatgaatttacaattgtgatttatgggttgtgggtttagggtgtagagtggttgacctaatatattgtgagtagaaataagaatgcattctggtgacagttctaaaaacataagcaattttatgctgagtcagtataaagagctggccagcctcagattttgtctgtgcagtttcatcaaaaggaatttggggtgagggaagtttgtctctatgatgtcattctaacgtcctttcaacggattctttttattcaataagcttttatttacaaattaatatgtgtcagaccttgaagccaatgctgaggatggagatgactgcttgcaggaaacttatagtgcagtggagaaaatagacactcaaaacacattattgcaattaaatgtatgaagtggttttacagataaaaaaggtgctgtggaagtacacagaatgaaacaattaacttctttagaggaatcagagtacatagaaaggtgatatttgatctaagttaaaatttgaataaaagtttaccagaaggacattcctagagagcagataagcaagtgcaaagtatacagctctgaagaaggcctgtaatggtgaaacattcaatatggctagagcaaggaatgttggagccagattgtgaagtcgcgcatgcccaatttaggagttttttaaaattccctttaagcatcagaaaagaaagctttcaattagtggagaatttcatgatcaattgtaatttttaggataagaagtgtatacaggggaattgtagaagtgtaggcagcagtgtagaagattgattgcaactggaaataatgggatgcagggagaaaaatctgtgaggccactgaattaggctagagctaagaatcgcattagaggtccaaacaatgtctgtggagatgaagagacacactcaagagatataagtgtgttcgaattgatagaacctcataattgattactggttgaggttgaaggaaataacagagtcaaggatgactttaaagttttaagtttgggaaactgagagaatagtgattaatttaccaagagaaggaacacagcaggaggagcaggtttggaagggaaaatgagtttctttttagacatgttaagtttaagatgctggtatgacatccaggtagcttttcccatcagcgattggaaaagtgtgtctaggattcagaacagatctgggctgttgttataagtagatttgagctcatcagtgtctcagaatagagatgccaggggatggatgagattacccagggagagtgtatagaaggttgagactagaaaaaggccaaggacaaaaacctgaatctatcatccatgaactgacataaacacattttgaaccaatttatatttttagccagcaccatccttcagtgcactgacttatataaaataaagtatacagacccgggaactaaaagtctggaaacagtatctcatctgccactgactgccaatcagtagagacacctaggagggaaaatatgtacccctttgaaggagaaatgacttatcttatgttaggcgaaatagtgggcctaattatcatctttttttgtaagatctggaatcctctttattgtcttagtccatgtattaccacctgtgagtcagaaaaaaatgtttttaatttttgcaaatgtatgtcagtagttgaatcttgcatcaaccaaggtaaagttgagcctaactcattattttaaaggaagaagatctcaaaaaataattgagttttagatcaggaaggatgaatgcaaacaaaatgttgattgggcacctgctatggtaccaggtacggtactagatgccttttaagtttactagttatgtaaacttaagcaagatacttcagctctgaatctgctttttcttctgcaaaattgacttcatcatcatcaccatcatcacaataataatgataaatttggaattgtacctattctattctagcactctgcaaggtgctttacatttgctcctcataaacacctgatgaggtatgcgctattatccccagtttacagatgagataactgaggcttggagagacataacttgccagaggttgcacagctaaaggagaggtgagagttaggatcagaaatcaagtcgatggctctaaagcccccattcttcactataccacactgtcttccatacctatgtcaggaggttgtgataagtattgaatgccatcatgagagtgatgatcttcaggaattcaaaaaatgttagtttcccttcattttcttcaacaaccttgccagcctccagtgaccaagcgtttataaggaggttaaacgccttttcattctgattatcattagaaaagggcagatgatatgctctataatttaccatgaaatattcctgagtctgcttatttccactttttagggaagttaatgttttatccaattgaagacttgttttgagaagtattaataagagaaaatactctataccagctgaagatatgttcatattatctttattttccaaaacagcagtgccctactccatgtatatgtggaatgctggactctaaaactgaatttcttattttccaaaagcttttgaattaagggatggacactaatataatattattcacaattctttgctaacaggatgaatgagccctaggcaggcttatttcatatgacttttggcaggttgaatagcaggggaagatttcctagaggcacacaggctagctatttttcccaagcagcctcacatccaagggaggcatcaattaactaagaaattagtattaaaaatgaaaatataaatgcatggagatatatataccaagggtaataattttagttgtgtgaattggccaataattttatatagataagattagtttttgaatatctccattttactgcaaagtaattatgaatgagaagtcatccatgcataaaaaggaggtatgttgaggacctgatacaagtctcacaaggtcatagactcctaaggtattacagatgacacaaacatttcatttctgtcatctaaatctgttcttttaacgcttctttttctccgaatagcatttttgtttggttggttggttgtttttctcttcaggattacaacctaaacctatatctcacattattgccatctggtggaaaaaaatttaaactgccattttttttttttttttttttttgagttggagttttgtcgcccaggctggagtgcattggcatgatcttggctcactgcaaactccgccttccaggttcaagcgattctcctgcttcagtctcctgagtagctgagattacaggcgtgtgccaccacaccttgctaatttttgtatttttaatagggacgaagtttcgccatgttggctagactggtctcaaactcctgacctcaagtgatctgcccgactcaggctcccaaattgctgggattacaggtgtgagccaccatgcccagcccaaactgccaatttttttttttttgccaagattacatggaagcaaagtttatctgtcatccattcatccatccatccaaccatccatccatccatccatccatctatccatccgtccatttgttcatttatacacttatgcatcagcatttatttaatgtaaactatgtaccaggtactgttctaggtaaatgaagttaatcttgaaataaatgtaccctagtgactatgattttctctctttttgccccagtatgataagccacttcatcccacagggaaaaatgcttaagcagcactgccacctgtgcagtctttgccctcaaaatttgagaagtgcatttctctattcttatatcaggcatttagcagtagtttaaatgattgtttgcttatatgtagacagtttagatatcagttccttcaaaatccttgaaagaactcttaatctcaggatctgtatttacatggcaaagatcacagatggcaggtgtaatattaatgtggcaaaacctatgaaatgaaaatttcagcagaatttgatcacatttaatgaattgtctgctgtgagcatactatgcttctagatgtcacaagtttctagcacaaaatccataatgactgctctgaaagaacttagactgtaagagaaattagccaagttatttaacaataactctaattggctcatgtctttcaactagtaacatttgttcatgaaaattcattcaataagtatttacttacacagcatctaaaactggaatggaatgtccatgacacttgtgccactgctccctctatttgtcccatggaagacatccctaattaatcatgatgctctttcccctgttgagaccagcttcagcctcacatccctttcaaaatggcatttcacgcaagcattgtcaatcaattagagttgaaaaaggacaaaacctatttctaaactttggtttgcttatctgtacaaagttctttgttaaactatgaagtttataggtgagtaagaagcaatctttgccctcaataaattcatagtacagttgggaaggtacatgtcaatcagcaatagtgatgcaatatgattgatgtgataatagtggtatatgtaaagtaccatgggggtctagaagctagaaccatgccgtgtattctgcctagggcatggtgacattgattatgagagaaatatctagcatttatgcaacaacagaccggaagtaaggcactttaaatggattctgttatttaatcttcccagcaatgctataaggttgggatcattattatacccattttacaatgaataaaataagcacagagatgctaagtaacttgcccaatattacagaggtagtaagtgatagaactagcatcggaacccaggcagtctgaaattagagcccactgtcataactactatggacagatagactgctgtaaatttagatcaattttaaagaaatggtgtctgtgtgtgtgtgtgtgtgtgtgtgtgtgtgcgtgcgcgtgtgttgtatctgtttatgcatgtgtttggagacatgtaatattgctaaaatgtccatattacccaaagtgatcaatagattcaatgtaatccctatcaaaatcccaatgtaatttttcttagaaatagaaataggtggttctattctatgaaactacgggagtaaaagagatgaccagtgaaaatacatacaatcagaaataatgagagccaattatcttaccctcagaagcactgaatttaaaatagtgggcagaagcaatgaagtggtcttgatatgtcatagaagaacaaaaaggaatgagtatcacataagccaaaggaggagacttttcagcaggaagatgtaactaatattgtcaaataatagacagtaacacagccagtttagaaggtcattgctgactttagactagagattgtccactttgactggacattaaaatcatctggagagttttacaaacctcaattccaagactgttccccagaccaattaaatcagaatttccagtgggcgggactcaggcatttaaaaaaaatatccttgggggatgccaatgtgcatccaagatagggatccactgccttaaaataagcagtttcaataatattcaataatattagagaaagatgccaactcacaaggatttgaagggtgagtgcaagtgaatgtagatgagtttattgccataaggctcaactggagaatgtttctggatctcagttggaaggaaaggctttgaaaggggaatgttcactgcatcctctaagacaggaagtaaattacaaaatatagtggtgagaagttaaagtagtttatgacttgatggtctcacccaagaaaaatgagagacagggttatgtgctgaaagtgtgaatcaagtcaaaggcttcagatgagtagtgaggtaagtttttgacgaggccaaaacagaattgcacatgcctatctagagctcaggtgaggtggaactgtagatggagatgtgggaacattaatgacaataaatattgttgaccactatgtgccaagtactctgctaactgagcttgcatatattttttatttagtccttatttgcaaccctgtgatgtaaagataattatcatggtggtgggaggcaaccaagcagtaaactctgcccctacatttcaccctcccttgccattatgtcatcttgatttactactgtcaccatcaactaggaagttttccacttagtgccaaaaccacagatggtctgggttttgtttctaacaagagaggtaatatttccttatataaacatttatacaacacatcccttcatataaatgattttacaaattttgctgatgagtatgaatgtatatattgtacaggtaagtctggaacccagtattggagaagggaaagaagccagaaaagtggataaatggaggagggaggtttatagtggtgcagtgtagatgttgcaccttcaggcatctttttgaaggtcatcatttctgtaaaactccctctttccccttcatcagttagctaggagtataggtaaccacagtcagtgacagtccatcacttcctagataccaatttattaccaaatggtaggagtcacctagtagggctaaatttgatttaaataatttgctatatatattcttaaattaactttatgaaacaatatacaattacagctaactacatacgtattacacaaatgtaattttacctttgaccatcacgtctctttgtggacattctttagctaggaaaagctaggtcagtttcaaaattctttggtcttgctgcttctgaggctacatgactttttgatctcagtctgaaaatagctcttgcctctgcgcattcattctatttctgtggtctatctctgagcccactttgctcaattctatgttcaaccctttgctgcttcttcctaaatctagattaaaaactgtaccatagtatgagaattgattctagtgttttcttcttaaataactcttcaccaaatggaattgtgtatttcttttgaggatctacataatatcagaaggaaaagactgactccctggctaagtgtcacatagatgattgtcccctgggaaacaaagcaactggtttttggggtacataattttgttcctccttttaaattacttcagctactgggcaggatcaaaggggatacatattcatgggactgtgaagactgggaaaaagagctttgtctttttttcttttaatactttaggacccatttattatataattaacacaaagaggcagagacacgggtcagtaagataatctgaatagatatcatggctaacacaatagataacatggctgaagtagcgggactgttcaagaatgatgtaaaaggaaagttagtgaaatatagaaggaatcagttgctaaacctaaagagtgaagtgaaaagacatggatttgattcagtagatgacagggaacctcggagggtttcagttcataggatttattggaactatatccaaattacatgctgcttctcttttattacaaggatttgaggaagattcagaaatggcattttgaaatgtagcaatatttcatattaacagtcaaaagcagttttaaatatctgcaaaggcataaccatgaggtatgccaacatgtcctgtcaggaaatcatcctgtcagcaaactgttattctgctttttttggtcatctgtgatgcagaactggctccatatacaaataagttctgtttattttcaacacttttttctcattataattctgaaagggtctagaggtgacggaagataaactttgaatcccttgagaccttgacaatattctcatttgaagcatttataccaaaagatgagaattcttctgtcccaccagtataaactgagccatatgcagtgctattttggtgccagtcattcttgtgacacatgaagtatttagttttgttacaccagagtcaaactgttagaggaaatgaccctttgtgtcttttatgtcatggaagaaagcagttagaaataagctcaaaggcaaaaataattaataaggacacacccaaacctttcatgaaatttaaaggtttgagttaagatttatttctcaagcttcaactgagatatttataaggcttcactactaaagtccaattatgtcttctcattaatggttgaagtccaaagtttcaagaacacttaaaaaattatcacattgacatacaaccaggctgaatgctaatgtgtctcaaattattcaataaatatggtcaaaaattaccttcactgacttgaaaaaagtaatctgtggttttgataaatgagatggtcacaagaaatgcagaattttattgtatgttttatatgaatacatatacatactaatgtcatatatttagtaatcagatgcacatacacacacacacacacacacacacacacacacaccccatacataaggaacagtgaagtgaatcaatttgtaatggggttgttctctaatttttttctattgattgcattttcttaagcaagatgtactagtatatgataatggaaaggcaaaacagaagagatgttatatggagcagcaactaacattcaaacatggatgcttatgctcctttttctcctgcagcttcccatcccacatactctaagccccaggtatgcttgtcaagtgctagtggttggcaagctttatgtttcttattggtttccttcagactacctctaggatagaggacaatcaacctgatttctgaagcattctaaccataacacacagccaggatatttagtcagtgtgttctttcgaatctgcaatatgattggcagtaccaaagcatctggccaatggaccagggaacatacctgatcaatttaacttaaaagtacaagctacaagcgggctggctgtaccatcattctgccaccatgattttataatttactttagagcttggaacagtatttggcacataatatgtattcagtgaatatttattgaacaaattaatttattaaatgtataacagcactttcttttggtaaattaagttggaaagagactcaaattagaattttccctatttgtcacattgattgttatatatatatatatatatatatatatatatatattttaacttttcatagaaaagtatgtggtagttttagtaaatgatgttttgtcataacataaaaatcaagtttagataaaataattacacaactgaagtccaagttcataaccctttgcagttaacaagagttagtctaaaatttattggctaaaggctttctaaaatacatgtgtcttctttataccactccttggtttgtagaattgcatttggatgtggaattggtttagaacattgtttgtatacacagaaggatgttattctggtcagctgcttccactttcattgcactagactatagatatagaagccattgaagaatggcctcaatgtagaaatgaagagaacctaaaagcttggaggtggctttgtatttttgatatttgtctcatttttatcaatgccaactactggggtgaatggaaatgtagatattccaattaaacaaggctactttttattctgtggttttttttattaattgtggctgcactgtactaataagatgattcaaaatgtatatttgaaacttttatttgcatgtatttatgtactgtgggattaaaatgtacatttcaatataaagtctgaagcctatgttgttagaattgtgacttcataagaatactgtgaagtctgtcacagtagaatttataatcttacatgacatccgaattcaacaagagtgtcttgagaaagttgcctttttaacaaactaaacagacttttcacagtcattcttttggtaaaacacgtgcacttttactaaaataaagctttaaaacatgggaactataaaaggaaaacaattatgcagtttttattactcaggttcggaaccaaagttcatagcacttaaaactgaatcacaaggctgtcaaggaccttgagagaacatacctttcaggcaggaccacactaagcctacccagctaaaaattacataaaatttgattctatttcagccctatcaccaagcttttgtgatagtgtgttgattttttactgcctacattattataattctacataaactttcattctacttatacttaagtctcaccagagttcaactcagcaatcactatttccaaaagaagtattcaatacctatttgttgatcactgattttgaaggcatcaggaaatttctaccattttctagtgtttgacagtatttagtactaagcacattttactaaaattccactggtcctttcctcttagagagcatggagtataaccaacaaccattaaccagtaagtagatactttgatacagtgcaatattttgcacgtaataggtcaagtatttaacaaacatttagtaaattgaattaaaaagttgattgtttttgttttgatgtatttgttgcttaattattcatgatggtataatagaaagaatactgaactaatagcaatttgggttcaaattgctcttttacttaatagcctagcacagtatcatcacagaataagtgcttaggaaatatttcctgaatgaattaatgaattgagttgaataaatgaagccttgggccccctttcccctgcaaccctctcatatggctcctctcacttttcaatgtgcctcaaggatggctttcccctgaggccactgtttctccatcaagggtgcctttggagcctactcttcattatcctatgctctacaaaccaaattctttactacagcactaagactcctctaccctatgttaaaaaccaacaagcctcaataaaatactaaacctacttcatggtacatgccattcagctatacccctaccaatcttaaaggcatggcacctcatttcttttatgtttttggatctgataaaattattcctattgatccaaatttggctatactcctgggtacatttgcaccagctctcatctctgactgaaacactgttccaaacccattcttcccctctaggggaaggaacaataaagtggatcaatttgtaatgggattgtcctctaattttttacttggctaggtacttctcagcctgtgagtctccattagagtctctacctagaaactacttgctctggaaagcctgccttggtgccgtgcaatcttgggtggatgctcctgctgtatactcctacagcagtctgtacttattactactgtagcactaatcaccatgaattgtaattggcttgtttgtttctccacctagactgtaaacttattgaggtcaggaactatgccttatttacttttataaaccctgtcatatagtaagtgctcaacagtttttttcttataatgagataacttttacaacgttttgtttccacttatgtaaagtgaggatgtttcctcgctgtggtgcagaggatcaatggaaattgtatacataaatcattctgaaaagtgccaggacacaagaattattcctgattgtcaaatcctttcacagatgcttttaacacacagattgccagtttcagccattttcagagagagattttctcttcatacttaggatctagtaagttgtgtcactgtaaataacagaatgaattggaactttatacataggaataagggagaatcctatctccacaccagccagtcggactttgttgaggatcttaagttcccatgcccttgctctgtaacttcatggtatagaaatagagcaatagtggaaacaggtttaacaaaattcttagtcctatcatggtaactacagttgtaatacctccaattaagctgctatgaaacactggagaattgttttcagttcaaatcttctagagaatgtctctgataaaaatgacgcctgtaatcccagcattttaggaggccaaggtgagtggatcacctgaggtcaggagttcgagaccaacctggccaatatggtgaaacaccatctctattaaaaatacaaaaaattagctgggcatggtggcagacacctgtaatcccagctactcaggaggctgaggctggagaatcgcttgaagccaggaggcggaggttgcagtgagccaagatcgtgccactgcacttcagcctgggcaacaagagtgaaactctgtctcaaaaacaacaacaacaacaacaacaaaaatacacaattaacatcagataatacaatttttaaaccctgaaagagtattgattaaaataaaattcctaacatttatcttttttatgcacattaatcagttggtttagaagagtcttgcttgactacaacttgttaaagcatcatggcttttgtacactgtagattatgtaaactttatgcaaaatagctcagcagtagatcttgtgctccctctaatacatcctgatggcattgaccccataaatggagttttagtgaatcttcaacagcagatgagtctttccccatagtgttcttcatcacgttctctgttgccttcatgccacaaactcatttgaaaggttttatgatccaattactaccaacaactattacttcagttactatcattacatagccatatttattaaaaattctgtacatactagtggatcattttattgtgaagttcaggaactgttaaaattttgaacaaattagtccaaacagtgtcctttattgctagattatgggaggcagattctattgatgttgtagtttgaataaatggaaatattgctctttatgatacagatggccttcctaactaagcatttactggattattttacaactaagtctactcagagtgagaatgaaagagtttctaatcttccaagggattttttttcttccttgaaaggttaggataactagaattggtagctcataaaaagtataaatcaatattgccattgacttaatccacataagaggcttaacttcataggtgacttctgaacagctgaaacaaaacaaaaatcagtctctggtgagttcccaagtttaaaatgaagttgaaagctgttacagaaaaatgcttctagaataacaacgacagcaggatgggaccttgtaaaccattatacttcagcaagtaaatcctcgtgcttacccattttaaagaacaataatagctcatctttaattatgtgtcagacactgtgttaagcatgatctcatttaacctttaaaataaccctgtaatatttagccacatttctaatccccattttacaatttatgaaattgaggcatggagaaggaggttatagtaaacagcccagttgaaacttgaacatatgtctactggacactaagtatcatgcccttaatcaatatactgtaatgtatatgtagaaaggcattcataaaatatagtcattggtgttcaaatgggtctataatgagagctgatgctctttacatacaattagaaatatctgcatggttttcctagttaatagggaatggtataccctgagccctctgcacttaatgtcagggatccactatgattagcattaggccaatataatttgcaagattgctgtgcaagaccgaagtgtatgccatggccaagggacagtgttctttcctttgccagatgagctgtctagggtgaagatcaaattattgacctctctctttctaacactatgaactaactagctgaattaactgagccaaaaataatttactcaatgataaccaatttactccaaggtgttcactggattatttgacaactaagtctactcagagtgacttctttttagtttttttttttttttcagttttacagcttcacttcttttaaagttcataccatctgactattgttttctccttccttctacctcattaaggtggtttgtcaatcttcagacttacagacatttttcagcgtttgatttttgcatcgtggtctttcttatttcattccctaccactatttgcaggaaacgcaacatttaggttaatgatttttcttagagtttcttgaaatacttagctcttgtcaagatcaccgaggtctccatggtgctaaattcaatggtcaattcttagttttcatcttgacctttcagcagcatttgacaccgctgatcattcactgtttcttctttacctggttttcaagatatcatattctgagcctcctcttatcctactgaccattcttctaactctcttttattggatccttctcatcctcccaactattaaacatcagacagcctgagaatccagccttcagacctcttctcttacctttgctacacttattcccttggtcagatcatcctctttcatacggttaatatcatttatatacagaaaacacttacatcaccagctttgacctctcccttgaaattcggattcatatatccagctggttattttttatttccacttgcatgtctgatacgtatctcaaacttaacatatctgtatcggacacctctgattcacctcgcattttcaccccacctttttattccagctattgctgcgcctactagctgcatgcagatatacactaacaacacgtttttttcaactgcatcagatagctctcattcctgccttttctgctacttgtatgtggaatgcctgtagcaacccactcagccattctgaggcatgtgcaagcctggaagtgtgagagggttaacacatcatgggacatcccttgatctagaagagaaagaatcattcatgactgcctccctcttttgtatttgagcagacaattctcccaagcattttacaagctcttcagagggtgccctgtaagatcaagcttcagctgctctcagctgtgaccagctcaaaaactcaccctttgacttgcctcacttctttatttcacttttactgatcctccattcttattttggggatcactttccaaaatttacttcctacacacaatcccttctttcactgtctgctttttgggaaaaccaagctgagacaatattcaaaacagaactcctgaccctcccttcaaaatctgctcctccgactttttctgtctcagattctggcaactcttatgtccacatatttatatcaaaaaccttgatatgattcgtgacctcatccattttaccatcaaaccttgtcatctctgtcttcaaaatatatccaaaatctgactaattatcatcacctcttttgctactaccctagtccaagccaccatcagttctcatattgatttttgcaataggcttttgactgatttctctccttttatgctcttacacccctacaatttactcaaaatacaatagtcagagtgatactcttaaagcccaaagcctatcacttccctgctcaaaacctggcatggctcgccatctcactgaggacacagacctacataatgtggcttccctttccatgtgtgactccatctcctgctactctctttctcaaccattctgttacaaccattctgttgtgattctgaaaaatataggcaatcactattccctctgcctgaaatgttctttcccttgatatctacctggatagggacctggctcggtctcttgcctgatgcaggttcttacccagatgtgaccttctcagagaggcattccctgactacgctattgaaaattacaaccctcctccaacacatttgttttcctgcttttttctttccatagtgcttatcatttaggtgaccatatgatttattgtctaaactgggacattttttagagtgaaagggtgtgctaggagtaattacactaagaccacacatataaaccagtactatctgagaaaactgagacattatggtcaccctatttatcaccatctgacatactattttgcttatttctctttatgctttacatatttatttatatttctatatacatatttactgtactatacgttcaaatatgtataactatacatttatacttattagtatatttttattgtattcatttgttttctgtctttcatactagattaagttctgtgagagcaaggaattttgtattttgttctttgctgagtcccagtgtttgaacactgcctaggacacactaaccaggtggtaaatatttatttaagtaaagcaaaccaacaaaatactaaaataatgtctggcacataattatctttcaatattgcttattgttatcaatacttattattagtgttgttgttgtttgtcctcaaacaaaagctattactttcagctctgagtgagaatggtatattttagatgatattgccctattttatttactcctcagtaatatttttatgagctgcctgtatagagatgtttgcatctgccaaataatttttatttaagtggcctgctcttctccagctttttaatcaggatgcttagtagttgggtggcttacaagcctttgtgattcatgacatacagatgaatttttcttttatacatcagggtagataataaaaaaaattagctggtaaaccctaaacccttgtatgagttcctattttaaaatatattggattaatttatttaatgtccagttgtgaacatgtttaaaagactcttgaacttatcattataataataagcaggatatctcttttatacttcatccagttgggaaacatagctaaaaatatcttaaaagaatgattttgagttctttcagtgaaattctagaaatgcaaattcagataattgtaatgatcaatcatttactggtatgttaatttcttaatgcattcaatttatcagcagcaggtttttcctaattctaaagaagcaatgcttaattctctttttactgattaattgtagagaattatacttctggcagttgacaaagggacttacatggcttgcttcaataccattcaagacataggtaaataataaaagtaaacaattcatgagaagtggaaacataattaacagcaatcttatgactgtttgtctcctcttgcaaaaatcctagtaagctatggcatgagcttccagttttctctggataagaagtacttgttagctaatcaatgtataatccccagtgatccttaaatattaaaaagttgacattagccaattagataattcaattggacaagcatttatggagcatttgctattcaagaaattttcttttggtcacagacaaaaatttaatacagcagcaccgctttataaaactcatgttgagaagcataactgatagcttttttattttggcttttgttttactgagcttttatttttcaagacacaggattttctctgcagtacatttgtagccttataatcgtgtgctgtgttataataggattgagctttattgagatatggttgaattgaaagttcactaggtaagttctttcattttaattctgaattccatgctgagtagctttgtcttctaaccttttgtgcagatagtgtcccttattcccatttgcccccttttggattgcctctactatgtggtctactagaaagatcatatcactgggtcaaaactcatgctttcaattttgcttctttcactcactgaatgacctcaggtcttcttttaaccgcctttactagtatattaatagtcacctggggtctggtggcacagttaatcaaagacctaaaaataatttgaaatgtacagccctcccttctgcctctagagagaatcttcgaaccaaagaagaaaagtaaaatgaaaagagagatttgctaggataatcaacaagatctctgtgtgatggtttccttttcagcactggcctgtctgatcctccttagtctcctaaaactgaaatgctcgtttctgagattcttctttataattcctcatttgaagaacagaccttagaaagtgacaagacatctatttgaaataaaaataataaaactggcgatatgtctttatctgcttgtgttgagatacgaaagaacagaaatgacttccaagttatatgctaatataatattgagcatgatatacatgaagacatggttcagaagaagtgtttgaaccctagcaatagacaaattgtaacaaaaaggcaggtaagaatttagttctcctctaaattacattaccatttctttttctccgctgttttttacctctctgcccaatgctatgaccagtattcagtgacttcctgttactgttaatagacttctactttacttggttaattgtagtcttatcaaaataattgtgaaaaattcaaaggtacattttggaactattcatagtgagccctgcggggcgggggggaaagcataatcttcaaggtgaactttagtgtgctttaagcacattcctctccagtggggaggatttcaaaacttttgtcgtttctgtaggcaatgaggtggatatattagaagcgtgaaagacaggttgaaagtgatcagttaggaaaatgttgcaataatctagagaaagagatgattaggagcttaacttaggcattaaatatccaaattttctaaaagggagacatacataggagataaatttaaattggcaagacttaggggctaactggttgtaagcaatgaaagagagaaaataataaagatttctgaaaaaaactggtttggctgtgtccccacccaaatctcatcttgaattgtagctcccataatttctacatgtcatgagagggacccagtgagagaaaattgaatcatgggggcagtttctcccgtactattctcatggcagtgaataagtctcaagagatctgttggttttataagaggaaaaccctttcacttggctctcattctcttttgcctgctgccatgtaagacatgccttttgccttccaccatgattgtgaggcctccccagccacgtggaactgtgagtccactaaacctctttttccttataaattacccagtcttgggtatgtctttatcagcagcttgaaaatgaactaatacaatttctatctttggcaagtcattaaagaggaggatggtgctagcaatcaacaaaggaaggtagggaagcaagaaggcagagttttagggggaaaaataatgattctcttttgaacgtgacttcacagggctgtagtttctccagatagaaatatctaatttgaagttagatatacaagacttggagtactggggctagaaaatggatctggatattgttgatacataactgatatttgagactggtgtgatcacactggaagagcatgtacagagtagaaaacataaaaggaagaggcaattgacaaaatcatgtagcacactaaacatttaaatgactgacaggaaaaggatcccaggaaaattgctgagaagtggactaatggaaattcaagacaagtggtattatagaagacaagaaagaacaaataatccagaaagagggaacagtatcgtatatgaaaaaaaggtctcgttaagtaaagactacaatatttaccagttttggcatttaggagtttattgctgactttgaaaaaagagatttttagtgtagtagtagagaaataagaaagatttcagtgggttgataaataaatgcaaagaaaaggaagtggagacatcaagtataggcttttaagatgcttggctgagaagtgatgggatggtcaaggagagaggggcaatagctaaaagagaacacaggttttaggaaggaatttttttgttgtctcattaatttgtttttttggatggaaaagaaacataagcatgtacattaacctagtcctgcccctcccacagtggcaatgaataaatatttgaagtatgaatgaatgaatacttatagtcaagggaaaatgaactaatgaagaaaaaatattaagtgatagaaaagagaggtagtatctgatggagcaaggtcctggagaaagcctaaataaaggatccagaatacagatggaatttttggtctctgaaacatgagaggagcagggataattgagggaatgtgtcatgtctcgtagcatctgctgtctatgttaagtaggagacaatgtcgtctgccaagattcagggagagagggctgtgagtagagtaagaaacattagcagaatgaacaatgagacagaaaaaaatctggaaagtggtagtagggttgcagggaaagttagtatataagttagaatctcggttgtaattgacagaaagtcaactcaaactagcttaagcaaaaagtggtatgaatttattggctcagggaacaaaagaaagtttagaatagcaaactgtagaaagggcaaggatatgactgacataggaaataactggagctaatgaatcaaatatgatcaatatagtatttatatttttctagtgggcattgaatttaaacttcattttctttcatgtacacaggcttagtaaacacaaagtgtgaaacatggctcatacaggctcttgaccatctcttcttaccaccctgatatagaagcagtgtatttaatgggtccaagacctagaatcctaagcaaggactttgattagccttgctttgttcagttgcccactcctgcatcaatcacttgtggccaggggtaggacctgcagaatgtactttgattgacaaagcttaggtcagatgttcacacatgaactgatgactgtggcaattgagtccatcattcaatgagaattttttgtgttctgacaatgtttcagatcttgttttaggtgttggggatagagttgtgaaaaacatagacatggtccctacttttaagagcttatactctagtaaggagagattgataataaacaatatattttggctattgatatattttattaaaaaattaaaacaggattataacaaagagtaactggcagtagggtctactttatttagccttgatggtcagggaagtctgaatagctgacacctggatcacaagaataagccaactatttgaagatttggatgaatattattcagacagagggaagaacaagggcaaaagccctgactgatacataagcttgggatatttaattagcagaaagagggccgctgtgagtggatcttagtgagtgaagagaagggtaatgtgagatgaggtgggagaagttagcaggagctagatcacataggactttgaagccactgtaaggaatggctattaggatttatccagtcaaatcaagtgccttttcttatagtaatcattcgaattgagggccacgttcctgggaaagggatattaaatacagtaattttaattttcttatcagtccaggtgcagaaacagtggaaaccaaggtaaaacttcttggaggttcgactgataagataggtcaagtagaaacatgagggagaaggcagaggtaatgctgttgaaagactagttaaaacagctgatcctggattccagaccaccatagaaaagagcagaagttaggagagggactgattgggaaaataaaagaaggttatcaatcttgtggtctttgtcaaggttgaaaagtaggttttatggccatgaggaagtccaataggtataagcataggctatcattggcggagtaagatttcctagtcaaaggtgttgtaatgtcctttcttattcagatgaatacttgtttttatatatttatttgtatccaacctaagtccataaataccttgttagtgtacccagtttccaaaaacttgctgattggggttcaaaaatactctatctccccgcctccctttttaagttgtgatcttttccattattaaacattggcttttttcccagggatggcactgaagaagaaaatcaatgacatatctagccagccagcttggactgaatgggcattcaaatagactccaagggccaagtacagatggtgatttattgtgcatacaacttctacagagtgccttcatttgagcatcgatgtatatacaattactcaccagaatgctgcagttttactatttagccaggaatctgtggagagattatgttcactaagaaatccacacatgtagtttctacccttttcagcaactctagaaactctcagtagtcttctgcatgaagaaaagagatttcaaaaatagttcttccattttaccatatttctcactattgtcatccttatgcaattcccatttcagagccaattcagatttattaaaccatgttcctctactggcatgtaagtagatggatttgctagaggcaaatcatttactgtggctattgtgaaacctaaaattgcagtagtcgtctccacatatcacaggctttcttattgtaaaaatcatttttaggcaatgtttatgtgatattgaaacaaccaagtggaagttcaactgtttaaatgaagcagatatttgacatcacacaggcagaaaaacaatgaaggcacttctaaattcctttttctcacggaaaacagtttgagtggccagtttgcccttataatttgaacttcaattgaaattgttagcaggttatttatagctttaggaggataatttccaaaaatcttgcttttcctctctggccaaatattacctaattgctatcctatttcagaaatggcatcatgtccagacatttataggtttatattgtattcgtgttttattatattaaggagactgggttgttggggtttacatcaggaattgaattatgttgctctttgcataaacatatatggagttatattacaatgtattttctttaatattttggctaaatttcagtgaaaaatgttaataattttaatagaaacacttcagaccaatcttcaacgcaagcaatatgatgtcaagattaatagaagctataaataaaaagaagctgtaataatattgataaaaatcagctcagcaaatgaaaatgaggaaattcaataacaaataatatactgcaatgacatagcccatcgagttgctatatgaggcaggatgaaaaatagccctttaaattatttatgtaccttgcagtataatcagtatcttggatagtaagctactagaaggcataaacaaacatcgtttgtatggtgctaagtttatcaccctcaaattaaatgtaaatatatgcatctgatgctgcgtagtagtgcttcttctaatgtttttctgtccatcatcattgacagacttttcagctcttattagggttttcttttcttatctgtattttctctttcctttctcagggagtatcttcttttggatcttagtatgagttttgttatggaaaagctcagggtctatgttggtacagatacagggagaagcacttagatgagcatcatctatttatttgctgagcattgcaataagcactattggagcaggaaacatacaatttatggaccctatcctctatgtatagagtctagacaggagaaataaacatatgcctttggggaagtttaaaggcacttaaatataactattcaaaaaattgaaattagctgattgttccatgttgtttgtaatcgaatccattcatttatgataacagtgtatctctatatagttatagtcattattgattttctattattatatcatttgttgaataaatgagtaaataaatgggtgaatatctttagtggtttttgccagtatttatttacggctgaaagatcgtggataagtgcttaatagttacactactttttttttttttttcttttttgaggcagagtttcactcttgttgcccaggctggagtgcaatggcgtgatcgtggttcactgcaacctccgcctccctgggtcaagcaattctccttcctcagcctcccaagtagctgggattacaagcatgtgccaccacgcccagttaattttgtatttttagtagagatgaggtttcaccatgttggtcaagctggtctcaaactcctgatctcaggtgatctgcccacgtcggcctcccaaagtgctgggattacaggtgtgaaccaccatgcccggcctagttatactactttttaagaattgtgaataggcactgaatatctgttcatcaagattgtacctctgtgattaaccaggcttgattttgcaccaaaacagtacagcattgtcattgcactcttagtatttattttgcatttgcttagtgttacatcaagaaatagagaacatctattgtgtgccagacaaagtactaagcactgagtacagtggtgaatgaaacaaatatataccccgtcttcattgagctgataaactacttagggataccaaatagtgctatgaggtgctatggtgaccaacagagtgtattcttagaagataacagggtgaggctagggatctacttagtgtgtccagggaagtaatctttaagctgagataagaaggataaggaagagcggagcatgtgaagagccagggactgagcattccaagcaaggggaaacagcatgtccaaagactataaggcacgaaagagtttggtgtgttttaatgactgtaaggaaaccaatgtgattatgttgcagaaagggagagaaaatgtactacatgatgaagttggggagtcaggtggagacaagacctaagggctttgaaaactatgccaaagattttagactttctcctaaggtaatgggactatattgattggttttaatcaggggcagcagtggggttcacatatataaaagagtactttggcagttgtttggataatggatggggaatacaaaaaggaacaagagaaatcagttatcaagttactgcagaagtccatgcaagaggtgaagctagaggcaagtggactaatttgagatatattcttgagatataacctaaaggaccttatgttcagggctgtatttgagtggacaggaagagggaagaatcaggaatcagtcagggttctggtggaggaaactaatgtccggaaaactgagaaaggaataggtttcaggttagaaatcaagaattctgttttaaatattttcatttttagatactcatgagacatctaagaatataaataggcagttgcatttaccagccaatgatgtagcaatttcagatatttctgctgtaaaaaattattgacatgagtgtttgaatgtcatgctttaattgatttggtaaacatttgttgggtctctgctatgtcgcaggtattgtgctaggcactgggaatgcaaaggcatagttgctgccaaaaaggagtttattataatcaaataaggagactgaaaaaaaagcagataatttaaaacacagtgtgataataacagtaggaggaacatctaactcaaataaggggttagaagggtcggggaaagtttcctggaagatatgacatctgagttaagttcaaaagtaaaatctagccaggcacagaggagcaaaaggctgtgttaggaaaaattgtaccaatagtggatttaagaaaaatacaaaagtgagcatcttaatatttctggccacagaatattttatgcctattacaattattattaaatatgtccataatatcagaatcatcgaaatgaaagagctgttagaaatcatctagtatagccacttagctttacagaaagggaattggactcagggagaagtgaactgtccaaatcatcaataattctactataacttttttgttttcaaatattgtaagtttactgtcaatccactgtctaaatggtgccccaaagcattaatttaatccttcaaattgcccacctgttacaagaggatattttatttccagagagattttgttgttctcaactctcctcagttattattttccacttaattcacagtgaacaatgtgaaacgatctttcaataagtgatacctatacaattaaacagctttgtgtaacatacagggagatatttaaaatataatctttcaaaagaatgttcatagtcacattctctttattcctaaaccatttatagggctccattttcttccactgggcaaaccaatggggttttgggagaaagatgaaagagttgattactcaaaattcaattatatttggttatcttatagcccttttgtttctactgctcctatcttctgccggactaacactctgatctgctgcaccactggtttcctacctgttctgccaccgttgtttctaacacgctaagaaatgcagttcctcacaagccatacaggcagtagtcaagaagaatacaaaaggagagaacataatccattttcctttcccttctgtccctgaaatgccaaatacacaatataaaggagctgaaatctttagcaaagagggcagagtatgccatgacaatagcagcagtgtctccaaaagcaaagtattgtatagtaggacctagctaatttagaccagttgagaataagctcatctgaatgtttgaatatgttagtaagaattgcattttcattattctaaaatgcatggagtcaggcactgtcatgtaatgcagtctgtttggaggacacttgtagtaatatctgacaaaaacaaaatggaaatgctttaaatctccatctgtggtgactggttaaaaaataaattcttccatctatgcagccattgagaaagatgtagacagatatatctccaatacattatattgttaaacaaaattaaccaagtatagaacagtctgcatcaaaagctcccaaatttcattgaaaatatgtaatccacatacatgtatacacaaatatgcacacatttcatttgatacacatatataaaggtatatgcacataaaaagatataatgtgtgtattacaaagtattcttctttgtaataaaaacatgagataaaatgtgaaaatgtctaggtggaaaataaattgtgcaaaatagtacaagtaatattatatagctctataaaaattatagagtagaatatgcaaaaatggtcctaaaatgcaatggaatttaaactgggtaaataaagtgtggccaaatagagatcctttgactcctgctttaatgaacagataagaatgattaccagttattggaatgtaaatgtatgcctttaaagtgctttttaaaagcttattttaagaagcttaagcttttcctctccaaattttaattttgaaattaatttgttttatgcacatttttcactaatagtaaatttctaacaaagcctgtcgaaattttaacaaattctggatttgtagaacattaacgaggactttaaacgtctttctaaaattaacaatggataatttctagtccctccttttaaagtgcactttgaaatactgcattaaaaattgtctgtaagttgagaaatgactcaagactgttctaatcactcttgataaatctttggatttatttatactctttgaactcatggacatattctatttgactggtgaatcaaatgctcacaaagttgggttgttggaacagggctttcccaattgtattttgtgtgcctttcttcctttggctgctggccttttggccttttcactgctcattaacaccttcttggcagtgtggagagctgaaaaaggtgaaatacaaactggttaatactgctaccccagcataaaaatctggaagtagggcttcatgaaaagcagaggttaattttctctactacaaccacatgaataatcaaaagttggagctatagagttggaggatttggttttaagattactcctgggattattttaaaatagaatttatgattgatttgaatatgaactcaccaagtgtagtgacttgactgtggaaccctttcagaggcaactcttgggattttttattccagtactgattgtgatcttaaacctaagtatgcagagatgcctgaaatttaattaaggtaaaaatttaaaaatttatttttccgtttgaattatgtgcaaggttagaaaaaccccatgtaaattggtggtaatttatttcacttgaatccctagggacttacatttccacattaataagaatacactgattcttacacacaagggtaaatatagtaactgagactcatgctgaaggtcatgtttggaatctcatatttcctttgcatcttagtttcatacattctttctggattctttctagcatttccaaatcctattcatcctcagggcctaactcaagtctcgcctctttgataaagtcttccttcacaacttctgacttccacatatattgctcactgccttctgtgaactccagtttttattgtctgacattcacagctttgcagttgactatttactggcttaagcactggttgtaaagattgtctccccagtgaaatgttaagttccttaaggattgcaaatacttttaattgtattggtatagaggtcttttgaattccttgcaatacctaacatagagttcctagtaggtactcaaaaatactgtactttttagtccatttatggactatgcatgaattacatttaaaattccttctatctcactattgccactgcctcaattagttgcatcccttgctagatcattttttttacaaggcaggacaaaatattgccactgatattgaactctagtttggcttatctgctggcagcaggctttcctgtagggcattgtgaacgtttacaaagctagtatagctaatctgctacagagctatcttgcccttttggtctgatttattctcattggccttaaatattctctgggctactgtggaagcccagaattcgacttttgcaagcatcaatgaccaggtagccgctttgtggaaccagaaatgatggcatgttcttaagtgagcatccacagttaaaggcgaaacaattactatggggaagtaaggccttttggcaggtgtgtgtgcgtgtacgtgtgtgtgtgtgtgtgtgtgtgtgtgcgtgcgcttggcgtcctccctccccttacaatctctgtctaccttaccagtcccagtaggcttcatgccacctcagattcaacacctttaagtcacattttaatatagcacataatagtgtatcttctttctccagcgtaggccacagaaaatgtttgcctcccttctctcttggggcctttaaggaatttctttctatcagctagaagaggaatttgagagactatgaaaattgaaagacttaggtgaaatcttatgtggttactctgcatccattcctgccgaggaaataactccagaggagtaagggaaaatatttaagggttgcaagagtcatcctacccttttcttgggcgttttctgctgtttcagcctcatggttcctctccctgaaaagaacaggtgtgcctgacagcaggtgtgtttgttctacttttcctatggcagctgtcactccccaggtaactctcttttccaggtggtgaattcttacaacccatcgtcttctttcctggctaccattactttaaaaaaaggtttggctgtcaaccctccctccttttagaatcttttgaaatgttattgttgtgattgttgatttttttttttttttgcttttgtgttttgggatgactttttaagggaaaatgcatcttcagatggattctgtttacaattcagacaaacttaacactttccttttaaaagcctccataaaagtctgcagccctctttgatttggattgagttttgaagccttcttctctgacagcgttgggtttctccattttgcattttccagtagatcttggggtctgtcctcagtcaagacacctgctgctgggactgccagtcgccacatgcttggctttcatcttccctcgtgtctattcatagcatgcacttctcataactctaaaagactgtttgatgccccctcattgtttaatatctacatgattaaagcagctgagagaattagcacgtgtcttaagcctaaggaaaaatccagtctaaaagaaattgtattgcaagcccagatcgtttttaataagctctgctgtgctctgtctcacctattcctctgtggggctcccttgggcattttataggtatttgagggttagctttaaaaggattctttcaggcatgtatttgactctcaatataacatttatcaagcccccacagtgtgcaggacccttacagtggtcccatggtaaggtacaaaagaagcaagcataccattttaacacttaaggaatcaagttacctgtcctttaggatgaagtgagggagaaaaagtgcacatatataaaagatttgggtacatgttgaagatgtcagatgtataggtgcaacatgagtatcaattcggtacacaaagggggcataaaatgaatgtgtaatcacagttggaaagatatagtgagagcctcagaggagtgaatggtgtgagcttaagggctttcatcatgagtgtcctcagggacttcagtaaggcaatgcaccgtgcagaaaagttggtattctgatagtgttatatgaaaataatagtaactgctactgtttattcaattgaatttttactttgtgtcaatgtaaaaagaatggaagaactagggagcaagacaatatagactgtaaagaaatacattcttaaagtgtcaattgtatgaccatgggttgaaatttggctagggaggtgggtgggccgtatgcttgtcgcgtgtgtctgtgcatgtctgtgcggggtatggggtggcagcggggaagaagaagcaagataaagagacttggagagtacggcagagtctgggaaatagaggttacggtatgaggtgacagcaattaaagtggggaaaggagtaaaagaaaagagaggctgtgttcaaagaaaggattcacagttccagatcttggaattaaatcctttaccttctgaatatatttttctctgaaaccttaggcttattttgctcattcagaataaaatagaatatttaactttgaaaatagggtttttacagaaaataaagtgcttctttaaaatgctaatttttgactctcagagtatgcccaatttttccacaaatttgtaatccatagtaattctgaggcatagcttatgggaaattaggatgctaaagccatgtcagaaaactaagcaagtataaatttacagtaaattattggagagactcacatcactacattagcacatggtttagctgtattttgacagtggaaaacctggcataagagtctctgggagcaccaggtaatatgcctgaggtccctttcctgcaggtgaattctctagtggcagctatcgcaatttatgccagaggcttatttttgtgcagacataatctctggtagaattttcgcagcctctgttgacagaactgacagtgtgtataggcccaggctactaggcaacaccagcatcagttagcagtcagcaaatatttattatgccttaaccatatgcctagaaccaagttagaagcaaggaggatatattagaacaggcataaacaatcccctcagactctttacagggctgacatacttaaagtaactaaaatagtgacaaggctatatttaatcaaatgccacattcgagggagggtgagtattttaggatgttagaaaaaggagagatcagttagagcactagattgggagagtcttcagaaaagaattggaactcatcctataacgcataagacaggtcgaatttaaagagtaagagtgagaaaaggaaggaaatctatgcacattgagaacaattcagaggaaggcaaaaaacaaacaaaacataacaaaacaaaacaaaaacaccctggtatttatatagtacaacaggagaccagcttgattgacatggaagatgtttgaaatcaatagaaaataagttaggtcgggccagagtatcaaagtactttgaaaaccaagtcaaatgttttgaatacaatacattaagaaatgggagacgtgtgatgatgaaaggtgggagcatagcatggtcatttaaggggcattttagcacaattaatatggtactgatttactggacaggttggagagggtagagaaaggtatacaaatattactatagctattggataagcacatatttaacttcaatttcacccttcaaggaagtcattcaggccattcccaacaaaatcctagattcccgttgttttttatgttaaacataaaagtgttaaaaagatctaagttcacatcagatgggtaatgtgccaaagttgtaacaaggtttgaaagaggcacatctcacacataaatatgaaaacctattgtttgagtcagtttccaaggctgaagggactatatgcacttacatcattggataaaatctctgtgtctctaattagcttcaatctgtacagatgttctttaaggaattgccattcctttttattagaccgagctcacaaatttttccatctaagtttgatgtagtatgttggaaatgactattctaggaaacttggaatgtatgaaaaatatggaggttttttaagaaaaagaaaagaaatatgtgtaagtaagaggtaaaaataagcaaaccaaaataacttagatggatgaacccaaacctaggttgtagctgaaaatagaagggtaaacaagtgccatcccaaataaaaacaaactaaagtaagaaaatgggcaatgcagagaaatcaggacataaaccaagtttcacttgaattatgcataaaaattaagacagttatttcagttttgattcatttgcttgtgtatacacttaggttttcacctgccaaactttgtaagttagtataaaattgatcatatttacatcatcatcaaatgacactggttgtcagatttgagggaggaaaatatttttcttaaaatcattggagattaagtctcaggaaagctacagcctcaatgaaaatcttgtaaatataattggtattaagatctgtttaattaaatggcattacaagggaaaagaaggtcaagtttgtctttaggtatttgtcttttgctttcctcggttatttccctacagtgcaatttattccatttagactggtggtggttcaacactggctgtaccttaggatccctatgggaactttcaaaaagtccactgcccagactccaccctagattgatccaagctttggtattttccagagctcctcgggggattctaataggtatgccgagttgagaagcactgtattagattagcaccagcatctttctctcttcccccctcatatagtcccttaaggcataacacttcttacaagggacatatattttagccagactaaatatttgtgttacactgatgatagaaagctcttgagggcaggtccttggtttgtttatttttctatcactcagtgggctctggccagtaaagtttgttgtattaataccaagtacaagtataagaggtagcaggattagaaatagggcccaggacaggctagtttttatgtaagtggggaggggaagaaaaaatccagattgtaaaatacagaagtcttggctatagtgggaagtcttcaataggtcctgtgaatataaaatatcaccttagaactatggtttattgccagattttttagttatccatactgtgactttaggtaaggtgtttatcactgggtgtctctgatatctctttaaaatgaggaaaatagttccagtcccatctaccccaaaagattgatgtgagattcaactgacatttgtagttatgagttcattttacagtatttttaagtataatatgccagatatatgtaaaattgttgtcgttatgatttacaaaggcagttaatagtctttttgtcagaatgaaaaacctagaataatccacagagcactgcaagtgcctttaaccaccaaagtcagtggaagtgtgaggaagacttcctttgcaaagctattcaaatacctcaaagattgtattttctataatcccaagagatgagtatgtccatgtagaacattgcataattttgacagactttaatagtgcaatgaaaataatcatagcgaaataacttgatgtgaattcaagttccagtacagcattaacttggtttatgagcttggataacatatatgtatatgtacttgtgtgtgtttattcattaaagggaaggagtcagtgtactaaaatttgttaaaatcattaatctatctatccaacgtacattaattgaacacctattatgggtcaggcagtatttttagtgttgggaatacagcagtgaaaagaaatagacacattgcttaccatcatgtaaacttacattctagtaggaagtggagcataatataattccaagtctatagaattgctattgaaaaaaataataaaacagggtaggcacatagactggtggaaaagggtaaaaagagtggatgtttcataggtgccaagatctaccataggcacttcccacacgttacttttatttataaatcttcacaagcatcctatgcaacaggtattgttatcttcattttaaggagagggaaattgaggctcagagagtttttaaaacttgcctaacattacctagtggttatgtgacagagttagaattgcaacttgcatctgcctgagttcaaatcccatgttctttctactacatgtggccagcacgtaagtgacttagtatatgtttccatattcttttctgtacaattcctttctgttgggcttcatcagagatttaatctgacatcccatgtaccctatatgttccacagatactaacactttaaaaattgaattagttattagcatttaaaagtaaaaagctgcatatagaagtattggtttccagcttgtctcaaagtattgaaaagtccagcaaaattgggcctgtgctcccatagggcagaaaccagctgaagctgagcagcatgatccctctgagacagagcatgcactctctgggtttccacagccactactaatccatgttgtcatagctgagccacttcattcatttatgttatttacctggcccatgtaaatatttgaatttgtgacccactagaacaaatacatgaaaaaccctcttccagttccaaagttttgattcaatgctgaacattcgggctcagttataagccttgtaactattcctttgacaacttagttatacttaaatgagtttttttctttcatttcttctccactttgtttatcttttatggtttaacaaccatgcaaacaatagccaaaattgcacattaatttctttactttttctattttaaaatatgattcagtgcagcacacacaaacctatatatttttagtctttatgcagaaaaaagtgaaacatgctaaacatgttaaaattctcaagcatgcatataaactgtaaatagcataattaacaagtaattcataatggcagttaaattctgccaatgtggaatcatgcaagccagtttagaagtccatgttttagttaagtctataattcaccatagcctttaaaatccaagtaatttattaacctaatataggttagaagagaaaacccagtcataatattgaagtgaatatagggaaagatgcctctcatgaaaatcattcaaagtataattattcttaagcacaacattattaaaatgtatttctataatataaaagtttttattagtattctgtgatataaggtaccctatgcagcattatgttaaattctgtctccatatttataagttttatagagtttattttatagcagtaaacaatgggatctctgctagactcagagtgaattacagttgcttaatggtgtgggtacaagttgatttgtcagctcacaggcccaattatctgttcttgtggttgccctagagcggccctgaggcacaatagcctctatggccaggatatctagcttgttcggtggttcatacactgttagtacatgtttgatttcatgcaggtggagtaggagcccacttcgatagtgcacagtgaagtatggcatgaagactccttcctcgtccagccacaaatgtcttcctgtatagcctgccacaatgcctgaaatttccagcctcaaatagtcatttctttggttaaattttcatccctgtccggaaaacaaaaccacttcaaaaaggttaagccattgtcccacatataaatagtgttggcttcattaacactatgaaattgttcattggtttgcataacaaaatgtcatggtccctgggagaacaggtaacgcagagcaggtaactcttaaggacggaaataggaaagtttggtctaaatataagatatttgccaggaaggtcatgcctagcacaaagctctgtggtagagagccttgaacagtacatacttggttgggggcagggtgttagagataaaggaaagaaacgttagaaaagagaaggtgaaagtgaaataaggttaaatttgacatagttcctgccaccctcttcctaggtccaatcctcatgttatctgttgcttataaatttaaaagacagttagacttcagatagtatgaatgcttgagaaatggggcattataactgaaagatttgttagtttagattgaaatgtattataaaataaaagtaccagtaaatttgcagatttctaagaaggggtttgataagggacaaaaagtcaattcgaaaattaaacaaggaaatggaaagaagaataaacaatgtaagaatattaattcatttaatttttgaattgacttttccccgttatccatccactgtccacagtaatttggaaacaaactgttatttacattttataatattgcattagttttctattgccactataacaacttaccataaacttagtggcttaaaacaacacaaatgtgttatcttacagttctggatagtcagaagtatgaaatgagtctcaccaggctaaaatcaagatatcagcaaggctctattcctttctgaaagctctaggagaaaacctgtttttcttgcattttccagcttctagaggctgctcatattctttggctcatgatctcttcctccatcttcaaagccagcgatttcatgtctatttgatccatcttccccgtcatacattctttgatacttctgcctcactcgtctacttttaaggacccttgtgagtacgttgggtatacttagataatccagaatagtctccctatcttaatgtcaacggattattaactttaatttcatctgcaaccttcatttccctttgccatgtaacctaacatatttgtatgttgtgggtattagaatatggatgtctttaggcattattctgcctaccacaaagataataaacatacattgttatactatgattaagacattgtgtttgttacaataatggaaatgggttgacaaattttattcccagacaaaaccactcagatttacgcattttagctaagtacatatataagtgacaaacattaaacaaaatgatgaaactgtttcaaaataaaggaacagatgaagatatgccagggaattttcaataaggagaggatagggcaaggatgtcaatatcagattaagtggaatttaaggccaaaagcattaaaatagaacctagagggattcattccataaacaaatatttattagatgtaactgtatggaatgatatgtgaagcatttgataaaactgcagttacagttgtgaaatacagatttctcagaatttgaaaagtaggcaaaaaataataccaaggatttgaataattatgaagcttgacctaatattttgtcaaataaatagaattagatactctaatgccaaaaacaaaaccacatttgtattttatgcccctggaccatttacaaaatttatcatgtactttgccacaaggaaaaccttaataaattctcaagtggaaaactggcaggtaacatcctctgacaagaattctgtaaagctagaaatcaacaattcaaagaccagaaaaggtaaacaggaaaaaacttagaagaaccataaaatactttatgtaagtaatttttggatcaaagagaaaatcaaaagaaaattttaaaattatttaaaaatgaacaaaaattatattacttcctaaataatctaggaatgtggctaaaaacatgagagctgcaagtaaaaaatatatgtgggattttcaagactttgcacaaaatatacatttaaattaaaatttattatttctttaaattcatttaacgctataaattttccttatagcattaactgaatttaaagaaatattgaaaaaaatctttcaactcaggaacagaaaaagaatatatagatatatatttcacataaaagtatctgtacaaaagtaataaaaatataagctaaaataattacaaaatttcaatgtgcaattaacaaagccaaaagctggtctgcgaaaatatgtataaaagaggcatactttgttctacactgaaaaatacactgatatacttcctaaatctcaaggataaagagaaaatctttcaggctttttggcagaaaaactgaatcatctacaaagaaaaaaatggttttctcatctatatcgtggaagctagaagacagtggaatagcatctagaaatttctaagagaaaaagactgcaaaccaagtaacttaccatccagtcaaggtatcattcatccacttgggtcagagaaagatgtttgaggacatgtaagaattcaaaaagtatatcactctcatacaccagtgaaaaaatatttgagaaaaaactcaaactaaataataaatgaatcggaatggagacttcaagatgagagaagaaacaatgatgggcaatgaacctggctctctggaaaagtaattaaatctaaatggaaaggcagattgacttaaatatctaaaatagtatcatttcaacgtgtaatcaatataaaaagtattaatgaaatactttgcattcttcttttgtgctaagtcttaaaaatcccacatgtattttgtacttgcagtagatctcagttcagactagccacatttcaagtgtacaatagtcacatgtggctagtggctaccatatggacagcacaagcgtctaaataaatatactaaactatcccaacaaaacacaggagtgggagtgagaagaagggaggactaacaagatccagaagatctcatggggttaggaagagaagtgagaaggattataaaagtgacattgtagggttaacaatgacaacaaaaggaagcaacttggatgtccagcaatagggcattagttaaataattaatggtacatttataacatataacatttaatatttccagattttgaaacaatgagttagaagcatattctatcttaaggaaacatgcatgttatattgttatataaaacaaacaagtatagtataatacataaaatacccaattttcataaaaataaatggaaagttttttaatgtgtctgtttgtatatatttttatgggtctagagaaaggtatggaaagaccttcactctacaatgagtatcagttgccttgtgacaagattggagaagttagatagggagttatttattaattttgtctttatgaacaactgtattattttaattgtaataatgagaatttgggggggtaatttctaaaacatcttatacagtataaataagaatgataaagagaaataagcagcaatagctcttgatgtgtggaagggacttgacctctgttcataaagtcagacaaagcctgagttgatagcattatttggtcattaaaagaggggcgtgagatttaggggaaactagaggtaaggtctttaaaaaaaaaaaaaaaaaagtcttgttatataaagggacttcctaagtgaagcatgaaacccagaacccataaaggaaaaaaaaatgacagatttgataatgtaaaaattgaatgcccataaacaacagtaaggggggatgggaaaacaataggttgggagataatatctggtacatacaaaatgcaatgtatatggatagcacattccatataaaaatgaaagaattacacaataccaataaatatatgaaatgatgttcaaattaatagaaagtaagtataaatatatataaataaaaatgaagtaactttttcacctaatttggcaaaaggaaaaagaaaatgattcaaatatttactgtaagggtatgaggaagctggaactgtggggggaaatatgaactagaacaattttttatgagaatctaataaaattcaaaaagcacatgcattgtgacccagcaatcagactttcaggaatttatcttacagaaagaataaagcaagagtgcagaaaggtgtatatgcaaggatggccattgaacattgcttataatagtaaatacttggaaataagctaaatgtgtggttctggtcaaataaattatagtagcctcagacaaagaaattccttgcaaatatgaaaaaaagttaagtagatctacgtgttctaacacaggaaagatatccatgacatactattgagaggaaaattgcaaaacattacatataacattatctcagtcttgtaaaaacacaaaaaagtgtttatgcttatgtgtttatgtatttatgtgttttctgcatttttcaaacaataaataaaaacaatgaaagtatagtaacctttcagtcagcatgatgtttagggaatgaggaattttcattaatccgtattttttttgttgattcagaattaatcatatatttttaaattcccatctttaattgttgaaaatctttctaaaatgactccttttctaccccagtgtgacatcgaggaagcatttttgaaccttcattctatgactgatcatctttagtgacttatgttcattattttgagtatcggttctttttgcctgaagccctaataataatgacaattgctacatttatagagccaggattcaaacccagttctctgatgccaagttcttttcagtacagaaaagcccctggtagctaccctcattgattaaatccctgaaatgatgtgtttgcttttcattcacttttattttcttacagtagaaagctagagggaaaaaagtcatttggttgaaatttttggtttgagtttcaataattaaagttttatgtattcaccatgtagcttaagaaatagagcattactaattacctttttgcctctgctgtgtgatcttttcagatcccagccctcttccctcacttccctactagatgaccgtcatcctgaaatgtgtttatcattcccttgcttttccttatagttttgccatgtatgtatgcatccctaaaaatatgtttttcagtttcatatgtttacaaatttcttaaatataatcatattgtgtttctatgaattgctttttgtgctcaatgttacattactgacatgcatccatgttaatgtacatagctcatttattttcaaggttatataatattccattgtgtgactgaaccataatttatttatcctgtagtcttttttgtagactatcatggcacagctttcaattgatcgaaatatcacagatatcacaatctgccaagaacctacatggccattgtgatctgtctgttcagtgttgtagcgaaataaatagacaaatcagagtaccactataaggcattcaatgagtatcaaataaaagtttgaatagggcactgtgagactatggagagggccaggttaactttggctaaagcgaggcttagaaaagagataatttgaagtaagccttgaaaaactgttacaactttcaagaggtagatatggggaagtatggctttctatgcaaagaatcactggagctgcaaaatgggaacataggacaatgttcagacaatgtttagcatagatgtggctggagtgtaggtacctgaaggtctggcttacccagtctaaatgggaacagatctgtaatcaaatcctagctccattttttaaaaaattgccaatattacttaacatggcaggttacttgacttgaccttgttctctcatctgtaaagtgaataatgcctacctctctgagtcattgtgatgactgtatctttaagtgcgaaatatatggataggtcttcgcacagtgtctggcacaaagtaggcactttcttaatgtcagttcccttctcttatttaacattgacttgaataaggcctctttcacttttgtttctcaaggaattgaatgggtagggcaatgaatagtatttttttttttttttttgtaatttctcttcaggctcagagcctcaccatgacattcctttgcttctgttagaaaactggttactatctggctcaaattttcagcctcggctgggcgcgatggctcaagcctgtaatcccaacactatgggaggccaaggcaggtggatcacctgaggtcaggagttcagtaccagcctggccagcatggtgaaaccccatccctattaaaaatacaaaaattagccagacgtggtggcacgcgcctgtagtcccagctactctggaggctgaagctggagaatcgcttgaacctgggaggcggagattgcaatgagtcgagatcatgccactgcactctagcctgggtgacagagccagacaccaactcaaaaaaaaaaaaaaattcagtatcttctttgtgttgtctccctctaattcctacttgcaaatatcaattcctgtactccagaaatagcccaagctaggatatgaagctcaggccagggagtctgggtagaaaaaggaagaatgtagagaaggtttctgtttgtttaacctgagctaagaaaccagcatcaaaaacagagcttcaaattgagtccacatcttatgagctagatgttccctttctatttcatttctagggacaaagctgatgtcagagcgtagagaattctaagcctatagattacctggctatcatggaagagtgatgagcaaataatagtcaagtggctttatttcatttgataaagttgagaaaagcacataacccagtgaatatactagtaaggagcagaaatttgcacagaaaatgaatgaattagacaggggtgttcagagtcaaattatatcaggaggcagcaaaaaagggaatgaccagctagcagagcaagcacataaacaaggcatattgtagttgaagagatgagaagattaaaaatctataggagaatttatcacaactcaattcagttcaatagataattatcaagcactgattgtgcaccaggctttctttggtcctgtggttgtggaggtgatatagtgaaggacagtttaaaatccaagtcaaaaaatgagaagcaggaagtctatgtggggttaaggaatgagctacaaacattcattagcagagacctgatcctgaagatactttgctaattcatctctaggccaccacttctgatatttgtattagtcagaactccgacagtgaatggtggtagcccaactccaactagcttaagagaaaaaaaaagtttttttggctcaagtaaccaaacaacaaggtggaacatggtcttagcaaaaactggaacacaggttggagtcatggactggaaaactgtcaagactcccttgtattcctacctctctctgcaggccagctttattatgtacaagatggacagctggctactgctgactgctccgggctgtcaaccttacagcctagctaactaaaaggaaagagatcctcttctgcctgctttcagtaaacatttaaaaaattaagaaaacctgaaaatgaacctggattggactagcttatttcccatatcaatatctggactaatcagtggggacagggaggaggtgtcttggtccattcttggtttgttttatgctgctccaaaagaataccatagactggataatttataatgaacagaaatttattggctcacggttctgaaggctggggagtccagtggctaaagatgtctttttgtgtcatcacatggcagaagggcaaagatgaggagtggaaaggtagaaagagagagagagagagagagagagagaaagggggtgaactcgccattttataatgagcctattcctgtggtaacaaattaacaaacccattcccacaataatggcattaatccagtcatgagggtgaagccctcatcatgacccaatcgtgttttaaaggtcctactttttaatactgttataatgacaattaaatttcaacatgagaactgcctataatcacagcactttgggaggcccaggcaggaagattactttaatccaggagtttgagaccagcctggaaaacaaagtgagacccccatctctacaaaaatcttttaaaaaatttagttgggcatagtgatgtacacctgtggtcccagctacaaggaagactgagttgggagaatcacttgaacccaggaggtcgaggttacagtgagctatgatgatgctactgcactacagcctgagtgacaggacaagaccagatctcaaaaagaaaaaaaaattcagtatgagttttggagggggaaaacattcaaaccatagcaggtgggaaatatgattggcccagactggatcaggtgtccaccccttaaacaattataattgtggcaaagactgcaatacaaaggtaggagcttttcagatcacaagtctaaaatgggggtaaaacaatggttttttttcaaagaggtgagattgcagtatgtagatggtcactgggggaatcactgtaagccaaacattccaccatgtggcagttctgttgggtaggagtctctccaaacatgaatggtctagagatgctgaaagtagggacatgtatttggaagcaccaggctaaaatggagaatacatgtgcagttgggatagcagcagatttttgacaggcagttctgaaccacctcaagcctttggttgttctctattgcctgtagaataaatcctgagatgcttattaagaccttcaaaatcttttttccagtattttctcccttttttccatctgtatgaaccctttaaaccagccagacttgaatatttactgagcaaagcactccgtgtgaagctacactcatgcaatcatcagtcctccagatatggaatcatcattctttatggtgtgtttctactatcatccttgcttagaatgcttttgagatacactgctatattcaccaaatatttatttatgcttctatgtgtgcaaagttttttggatactggttatacaatgatgaacaagacagacatggtccctgccctcagagaatttactttttttctttttgagacaaagtctcactctgtcacataggctagagtgcagtggtgcgatatcggctcactacagcctctgcctcctgggttccagcgattctcctgcctcagcctcccgggtagctgggattacgggcatgcaccactatgcctggctaatttttgtaactttagtagagacagggtttcaccatgttggccaggctggtctcaaactcctaacctcaggtgatccgcctgcctcagccttccaaagtgttaggattacaggcgtgagccaccacatccagccgagaatttacattttagtaggagtagagagtttttatgtaattataaaactgatcctaaaattatgatgtgatgactgtgataagtactccagagaaagaaggacctaatctggtctggagggtcaaggaagtgagatgaaatcaaatataagaaagaattaaccaaatgaagagatggaaaggggcaggaaggagaagaggaacaacatgcacaaatgtcatgaggtgaaaagtaggatggcgtatttgagaaactggaagaagtacatgttgcagaagcaagagagtgagtggccagagaagtagacagggaaccaaataacataagactttgtaaagcatgttaaagattttgatatttatcctaaatgtaatgggaatatactgaagggaggtgatgtgattagtttttagcattctgtctggtagcattgcaaacaatagattagagggtaacaagattggatggaagggtaccagttaggtcattgcagtcatctaggccagagattattgaatgtgaaaatggaaaaaactgtattggctcaagatataattagaagataaaaatgatggtatgggggatgcctatgtttctggcctgtgcaaatgaatggatgatacttatattcacaaaaaggcaatggtaaaggaggatcaatttgaaggcagtgataataaagttagctgtggacatttttaaaaatgtaaggcgtcttttaaatatctatatgacaaatgaatagttggatatacaacctggacaacagtactggagtctaaactctaccctctttcattcaagccttacccattcatcaaatcctagcttaatctaccaactccacaagagtcactgacccatttttctcattctattcttcctctcctctgtgccctctcctagtgtttattgcctgaaccaatcattaggttccagttatatactctacaatatatatggggatatatgttgtttccattaccagacattaagtttgttgaaattagagatccatattagattacattatacctccttaccaccagcagatatacatgtagtaagagatcattttacctgtaacgaagtgaatgcatagcctttctgccactaaagcaatattagaagcaaaaggtgttaaatacaaacaaaattggatttgaattttgacttcacctcttactaggaatggtgaccatggtcaagtattttaacccttcagagtcagtttccttgcttatcaatacaagataataatacatgcctcaggaagctattgttcagtattaaatgcagaatgtatgtaaagtgtatagcacagtgtttgccacaggacaagcactagaataaccattatttgttgttgctgttatgactattattacttttgtggagatcaaaaaataccataattacatatgacaagcagtggctatggtgaggtgacaagttagtgaatacaaaaattggtataagcatatgcctgtttctccatactttatagtatagtaagattttccattattctctacttcagaaagcagtcataattttgttgtctttatttttggctggaggttggcctctggttttatagaatattccactggagccagtctcttgtgttacataaagcataaattaaggtatggctaaattcacaatgtgagaattgtgtgcacatgtgtatatatgtatagacctatatacctattaatcatttttatcaagaaggcccattgctcacagtgtgtaccatatattggtcattatgttgctggcaagcaaaaagaaatcacccacttaacaggagagaaacacattaactcttcaaactagtagggggtgcttttactaaattacctcctccagttgctttaatggtaccctagtctccacacactaatgcatgtctgagcagtaagtagttttctgtcaccttactaggagaactaggatatttcttttttaatatgaagagcttggggagagggtgtggaagttcgtttttttctttatatttgtaaaatatttatttatggaatcactatgggaacgtatataaatgtatagtagatataaattgctagttctatttataaaaatccagtatctcttttaagtcaatggtattagtaagaaaaaaattatgatcaatgtttttccaacttttacattccagtgcatccaattttatatttttttactaattcttaatggaaagaggttcttattgaaaggtacccttggaatctagtgatatttttaatataccagtagatgatatatattttagttttatatatgaataattataattcaaaatggcctttccagttagctttcttttcacacctctcctaaggcccatttgaattttatgtagtttaagaaataaaactgatttcctagatgaatgaaagttgtctttttataattttagcccaatgctaaaatcaaactgttcgcaagtggactgtttttaaataaccctacccagatttggaattttcagagcaaatactatttggcatttatatagcacaccctttcaagactggacttttatttattgattatacgtcatgaagtgaacagtgttacacttataattttatagctacactgtagagtaattcaatttttcttcccccaaccccaccccagctccccatctctgaagtgcatggtgattatggtgttgcaggtgggctctgggttgactagaagagctcttccccccaacaaaataaaactctctccccaaccctttctccatccctctttcttgctccctctctccttatcccctctctcaggatattgagtttccaagtatttagccaaaaatattttgggaagaaaagtgaacacacagaacagggacaaatgtggcatatctcagcatagtctcccagggtcctcaacttccctcaaatggaggatactgtacagagaagccattgacatggttttcacctagtagatttcagttcgatggaagaagctaaattcctacttgtcactgctttcatatactcaattttgctgaccctctggaggaacctgagttaataccgagatgaaatgcacagacaataacatatagattaatatacagatgaaaatctgtgtgattctgatactaaattttgactgagcacagttattacaaatttatttccgctagaatatgagttccatgacggcagggatttttgcctgttttgttcattgctttatctctgatacctggaacaatgcttgctacgttaggtggttaataaatattttctagttaaatgaattttcttacattctggattaaaactcacagctagcgaatttccaggctgctttgtagatgtatgcaaaaaaattgtaaactcggttatttgtgttcagattaatgattctggagccctagcacacaggaatagtaagcagcatgagatataatctaaggcaaacaaggcccaattccttagtatggtatataaggccctttacaaactggctccatcccactttactggttcttctacccctacacttatagtacagatgcagaaaattgtttgctgttctttaatttcattattcccttacacttgtctttgcccttgaacacacacttctctgtgctagaaatgctcttatccactttttaacctaccagaagtgcattcatcctttaagatgaaactcaaagtatcacttctctggagcctgtctcagtctttcaggcagagtgagtccctcactttgcttagactccacagccctttatgtatagatctatcacggcacttacttacctccttgtcctatcatcatttccatgtctgcaatagattgtcagcccttcgagggaagaggacgtatctttttccttctctctaatctgcctggatcctaccacagtgtctgtcacaccataggtgctccgtgagtgcttattgaataacatatggactgagggcatgaaaactaagggttgaagtgctctattaaaaattataggccaagtgccgtagcttatgtgtgtaatcccagcactttgggaggtggaggcaggaagatcacctgagctcaggagttcgacaacagcctgggcaacatagtaaggccccatctgtataaaaaattaaaaaattagccgggtgtggtggcacacacctgtagtcccagctacttgggagactgaggcagaaggatggcttaagcccacgaggtcaaagctgcagtgagctgtgatcgcaccactgcactccaaagcctgggtgacagagcaagaccctgtctcaaaaaaaaaaaaaattataatatataatttggcattagtcagggaagagaaagtataccaaacctagcttaactttttcagattcgctaacatactgctgtgctgttaggcaactggccaagaaatgagaacatttgaacaagaaagggggaaaaaacaaatggagctagaattctggaaaaggaagtgaaaacggccaaagtaattgatgctgaatatggggagggagagggtgacagacagtggatggacaaaaggaacagatctaccttaaattgtgcctaggagaaaccttggaaccagtgacaaagccaagtaactatgtcaaaagtgaacatttagccaagcatgtgttttgtcaatatactatcaaatcactatttggctctttgtgctttttccccccaaggtgatgatttggggaccaaatggagtcaactgttccaggcatcatgtagactcatattacatctatcctgtatatcattaatgtccttgggcaatcctcatagattgttttacctgcacatccttccaaaatgtgtaaaaggaacatgcattcatgtatatagattgtccattgttttttaaatgcctgaaacattaatttgattgttcagattaagtgtttggggcaatgataataaggatttggataatataagtttccagttcaaaagcactaatgtcattgttgctgtttgcatttgctttctagctttgagaggttttggaaaatgcattttgcaagaattgcctgcagtgttagcactaaatgatagtgtggaggtaaagagaagcatgcctttatctaatttcatacctccttgataaatttcaaataaagaaaaatgttcctaaacattttaccataaactgtagaatattttcaactcaaagcctttctctgtgtactgtgatacgtgtaaaactctgaatgtagatcacagatataggcttagtctatttagcatgagatgataatactaccttgtaaacaggaactgcccccaaaatttgatctgattgcttcctctagttgggtgataacatgctgaagtaataccccaacacacatttctcagtgaatattattcctctcatctttgttaatgttgttaaataatttcaaaactctcctcaaggcagctgctctgtgctagggagctaaacacaagagaggccaatgttttcttttatttgtccgcctgcagacacagatgttgtttgtgttgtctggaagcacagaatatgctctaaaatatcattgttgttttcaatgagtcaaagtgacaagttgcgggtaaagtgaatccataagaattagtacagagtggaataatacttcaaaaggaggtacaaaaatgcattaaactcatatagaacaataagctattaatgatatatgcatagtttaagggtctatttttatattgtcagtgacaaaagaagtgcccattgtctcctggctgctatatccctcaaagtattttggcggctggctgtggaaatccagatggagacagcagtgaactgaatgaaacctgggagacaagaagcaggaagttctagcatccgccacattcacattgcacaaatgaggactaagctgtgaatttgaatgtgctgcttataatatgctgcatgaggtcattaggatggtgttaaaatggttccaagttagcattgccagttggtatctgtgtgactttggacaatttatttaatctgtcattgaatgttggttgctttatttgaaaaacaggactaataagctgggcacagtggctcaagcctgtaatcccagcactttgggaggccgaggcgggcatatcacctgaggtcaggagttcgagaccagcctggccaatatggcgaaaccacgtctctactaaaagtacaaaaattagccaagcatggtggcgggtgcctataatctcagctactcaggagcctgaggcaggagactcacttgaacccgggaggtggaggttgcagtgagccaagatcgcatcactgcactccagcctgggagacaagagcgagactccatctaaaaaaaaaaaaaaattggaataataacaacctttctctcagggctactctgaggattaaatgaaataatatatgtttcagggcttggtacatagaaaatgctaaattcatggaggtcaagctaccaaggaacatgcagttttacatattaaaaaagaggaagaagaaagtaaatccaaacattaatttagcatcttcttttttaaaaaaatttactttaagttctgagaacatgcacacgtatgtttattgcaacactatgtacaataggaaagacttggaaccaacccaaatgcccatcagtgatgggcactggataacgaaaatgtggtacatatatatcatggaatactatgtagccataaaaaaggatgagttcatgtcctttgcagggacatggatgaggctggaaaccatcatccttggcaaactaacacaggaacagaaaaccaaacactgtgtgttctcactcataagtgggagttgaacaatgagaacacatggacacagggaggggaacgtcatacactggggcctgtcaggaggtagggggctagaggagggagagcattagggcaaatacctaatgcatgcagggcttaaaacctaggtgacgggttgataggtgcagcaaaccaccatggcacatgtatacctatgtaacaaacctgcacatttggcacatgaacttaaagtaaaataaaatttaaaaaagaagatgctaaattcatgtttggatttactttcttctttttttgatatgtaaaactgcatgctttttgctagcttgacctccattcatttctgccccaggactagggaatgcgtgctttgaaatcagaactacctagaagtggttaaattaaaaatcttgtgcttagtcagttgcaagtgaattttctgataactgagataagttagttttccaacttccacagctaatagagaatggcctttctttctaaataaaagtttgtaatgataggactgtaatgtaaataccactctcaaaaataattgtgttggttcagatctactatacttcagaatgaggttgactgaccctgattataagagtatatgactactatgttagtgtttgcatataataacccattctgccattgactatatatgctatgccactaaagagtctttgtagaaattaatggtaaacaaagggtacattatcaacctcttattgttgagaagtagattctgagggttttttaaataatagggcttcatttgcgctgagttaaccatatcctctcatctagttcttggaaataaatgacatgcattcaaccagaatgaatagccaggattatgagagaaatttgtagctatgggacaaaacaaaggcaactagactgttaaggtggaaatggcaaatgtgtcaccgatatcattgagtctacctaatctgtcatggtactttatcattgagcccagattggcccatgaatctttcctgccagattaggaataaacctcatttgttggtcatgtttgcattagtctgtaccaatctagccattcaggattttggtatccagaatttaagcccttcggattcccctggagtaaaagtaaaatggcagacaagttgagagaaattgatctgtccatttccctcattgatgacagtgtgtgaacacagattggtttttctgttttatcagccttgctgctttgtttcattgttcccagtgttcttcttggccatttaaattaggcaagcagagtacattcttgtcttccccctgtattttctagaaacatctttattgaggtaaaattgacatacaataaactatatatagagtatacgagttggtaaattttacatatgtatatatccatgaaaacatcaccacaatcatcacagtgaacctacctaccacccctaaaagtttcctttcactgctttataatgcctatatcctccactccccacacaccccagtccaggcaactactgatctgctttccctcactatatattagtttgcattttctggatacttacatacctggaagcacacagtatgtagactttttatttggcctctttaactcagcataattatcttgatatttgtttatgtcgttatattatttatattaatagatcattcctttttatgtctcagtagtattccattgtatggatgtaccagagtttgcattcatttgcctattgatgttctttatttccagctttggctcttacaaataaagcttctatgagcatttgtgtacaaatctttgtaaggacatgtgattttatttatctttggtaaatattgagggttggaatagttagatcatatggtaagtgtacatataactttataagacatgaagatatctagggccaacattgctctgcacccacctaacaaagcttaatagcaagacccaaaaggataaaaatgttgccaagtaatttaagcacacactagaacaaagctttatacgcaaatatatacagacagtccccaacttacaatggttcaacttataatgattcaacttaatttttttttactttatgatggtttaaaagcaatacacattcagcagaaaaaatactttgagtacccatacaaccattctgtttttcatttttggtatagcattctataaattacatgagatagtcagcactttattataaagatagcctctgtgttagatgcttttgctcatctgtaagctaatgtaagtgttctgagcacatttaaggtaggctagactaagttatgatgttcagtggattaggtgtattaaaggcatttttgacttacaatattttcaggttacaatgggtttatcagaatgttaccccattgtaagtcgaggaacatctatctatgaattcaaaatctgttttgagtattctattcaatgcccatgaattatgaggttttccactgtggatgttggaaacagtgactatttccagccctgtttcagattcagaagttgtttcttttattcctttctgatggctctttctccattctcagatggttttcttgcacgcatgtgctgtccagagtgcaggtgaatatgcaggggggaccctctgaagatctatggaattctttttctgtgcagttctctcctctctggtactccgtactgcaaactctagctatcttggccttcccgcactaccagcttagtcttctcaactcaaagagactaccaggctctacctgtgatccccctccttgtcctgaggcctggaaactcttacagggtttacctaatttgtttctcatatctcagggattgttgtccttcattatctgttgtccaatgcctgaaaactgttgtttcatacattttgtgtggctttcgttgttgtcatttaaggcaggagaataaatttggttgctgtcactccatcttgtttgcaagtggaagtcttctccagaatttaatgttttcctctgaatggaattcaaatttgcaagttcctgatgagtgtccaaaaagttattttctcaatctttcccaacttagaaaatttattcattcattcattcatttatttatttatttatgatgaggtctcacactgtcacctaggcttgagtaacagtggtgcagcctcaaactcaggggctcaagtgatcctcccagtctctcaagtagctgggactacaagcacatgccaccacacctggctaattttttttttaattgagacagagtctcactttgttactcagcctggtttcaaactcctggctcaagcaatcctcccaccttggcttcccaaagtggtgggattatagtcaagagccacccacatccagccagaatttcttttttctatccctgacttattttttttagtaacattctctgagttcctgaaaacaggctgtcagaagagctacatacccactccagggcattctacaaacttactgagatgataaattctatctgggatatggcatgaaactggttgatgagaatgacaaaagaagtttctattcaagccagcttaaagatggtcttttaccaaggctttgtgactagtttcagtaaaatttccccagttctacaccctagagtacatttctgaagaattttaacaggcaattatttcccagttcattatgccaaaaagtatagtgtagaaagcttcctttgtgtgactatttcagtcagaagatgatactgagtacttgttctccattagtctaatattataaattgtattttcctgaattcacagccagtgggctgctgtctttctcctcttgccaaatttgtggaacatctgttatttgaaacagacagctaatttaccaaaataacaatttttcaatttgcattggtaggcattgttttatgttaagctaaaccacctcaaatgtgtcagaattgggttcaagttgttaaccctttcaagagtggttccatgttaactactaatttttaaactttggtgtttagggtcactctttgcctagaagtagtctaagttctgaggggatggcaataccaccttagaatgtaatttattctgtagttgatgatggacgctgactctgttgtaccattctatcttggcatctttactcattcatcacaaagtaaatgcttacagagaagtatagaatgttacagaaataatattgcttgcctctatgagtatgtatttgaagcactcacaagtgtttttaatggttatttaactctagctcattgatctcacttctctagatagaattgtgcagcagattgatgtagtttaaaatttcagacacacacacacacgcacacacacacgcacccattgaccaaaaagctgcacatacttagtgaacataatggaaatacacaagtatacctggaagaccacaatgggcaacaaggattcaggttccaacgagttatgaccagccagaaaattgggccagcacatgtaagaaatgagaaatttttagggccattgagcaccatgcattttcagtgttcagtagccctgaaaatttctcatttaggccaggaagtctctgtctcattcaaaatgttgaaataaagggaacatgcacaggttctcattgatctaaatttctgttgaagtccaggacctcccaccatcttttctagtccctgattctttttccagactcttattacaaatattgtagagcaagcatccaatttttgtcattgtagtggtaactgctgagttagcttcaaaacaagtgctcccatcttatgtgaatacagtctaaatggagccgttcactaaggtgaaaattagtttaaggaaatagttagcatttgcttattcccacatcaaattttcttcctcttcttagattgctgaaggatattttaatctctctctaaatatgattggagttgttttgatttcttccaggtttctacctcgtcttctttccttttgagtcctgatacaattctgtgtcctctgatttgagccatttttacagatttttaattcattgtactcctgagagcatcctttttttgatattaacatagccttttaactgcattctgggatgtctccagttagctaatattggtcacaaagcatgaatgtttctacttcaggcttttaactctgcccagatttgttgccatgcttttccgtatactgacagatggagaaatcttgaaaattaaataaggcataattagtaggtcctgagtgccgagataatgggtgcatttggaactgtcaaggggagattaggctccaggaagcttagttattttatttaagtcatcttataaccacaggctccagtcttgcacatgggagcattccatctctcactcctgtgccccagaaaaagctgatgagccctcagcagaaaaataaaagtcaggtttagacaatgtgcctttattaccttgttatcattaggggcttaaaaaggctctgtgtggaacttcccaaaggacatgacaaggtcctgttaactcactctgctcactgcctagtatagcactgtacatttgataaaacattttcatgaagaaaggaggaaattaaattgaactaattttctaagactaagagaaatcagaggagactattttgttttgatttctttactttaaattgagtgggtgttcagtgaagctgtgtttaagtaaatttacttgaactgatttggttgacaatttgataccgttttctttttaaagccctcaaactgagaaatagaaaatggtacccagtagtgaaaattatttgcctcttatctggtgttacttacttctttgtctctgtatttcttgcttaagattgtaataatccattgcatttttccctggagccagtaatgaattattagtgggtcagtaatatttttaattgtgtgaattttattcattatgtttccaatagccatgttgtaaatggatacttttatatttgatgagtaacaatttactcagttgctttttacattttaagttgtagattctctgtttctctatcaataatcttgcaattcatagtaggtacataggctgtatcaatactttaatatagcaggaattataattatggcacaagatcttatttaactaatatgtactatatccttcacaaagaagtataaatggctccttgattcatgaaactactaactcttttcccatttgaacacattgaccattacatatgttggataacaggttcgggttataattatagaattttagaacaaggcagttacgtagagatttatttctagttggatccatacatcttacaaatgagaaaactagcccccaaaatgttaagtgacttatccaaaaaccaaatggataattaataacacttgcttctgcatgtaatctataagggttgttatgagtcacagtaattaaactaataattctatcccctcccccctctcctttattttggaaatgggctatactctttaaaagttatatcccaaatttctcaggtcatggttaaaattaatcacacttcttgacttccaattacttatttggagcataatgccttaaagctcactttttagaggaagcatggggaggtagaattttagaaaaaatagtcttgagcttatcagaaacacagaaattggccgggtatggtggctaatacttgtaatgcttgagtccaggagttcaagaccagcctgggcaacactggggggagctcttctctacaaataattttaaaattatctgtgtgtggtggtgcatgcctgtagtcccagctactcaagaggctgaggtgggaggaggatcacctgaacctgggaggtcgaggctgcagtgagccaagatcgtgccactgcactccagcctgagtgacagagtgaaaccctgtctcaaacaaacaaaacaaaacacagaaatggcatttctagaaaaacactgatacagatagctataactttccttctcaagttttgataaatggcttctttaggctgaacacctgatgatcaacccctagattcagaaagtagagtcatttatttttttttcagtgcttcatagcatttaaaaaaaaattattaatttgttagcattagtagatgtctaaggtggtcctatgtgccagaccagctctactcaatctcatgatcctcaaccataaatgtttccctagctgctgaaagcttagcagtgatgagtttcatccttagtttccctcctaaatttgatgttcaactcttatgtgtctaggacaaaagtacaccctagaagatcactgagaaatcatgcatcagtcgggcatagtggctcatgcctgtaatcccagtactttgggaggctgaagcagatggatcgcctgaggtcaggagttcgagaccagcctggccaacatggtgaaaccccgtctctactaaaaatacaaaaattagctgggcatggtggcaggcacctgtaatcccagctacttgggagggtgaggcaggagaatcacttgaacccgggaagtggaggttgcagtgagccgagaccacaccattgtgctccagcctgaacaacaagagcaaaactcaatctcaagaaaaaaaaaaaaaagaagaagaagaagaaagaaagaaaaaataaatcatgcatcagttagtcttcatggcctcttggcttagatataagcaagatgacattttgactacctttttgttcgtgttacatttactttattccactagagagaaaagagcaagacctccttctagctgtgaaaattgattcaaaagtctccttgttgttttaatatctggtggtgtacaatcaactaaaaatctttgtaggggtataattgaagtataataaactacacttactacgtatacttaaggtgtgcaatatgataaactttggcatgtatacacctgtgaaactatcaccacaatcaaggtaacggacatttagatcaccccaaagtttttttgtgtcccttgttatccatctctccctccacccttttccccaggcaaccacgtattggctttatgtcacagtagattagtctgaattttctagaattttatataaatggaagcataccatatgtagatttttgtctgtcttctttcacttagcagagtcattttgaagtccataacattgttatgcatcaatagtccattcctttttaggactgagtaatattccattatgtaaatataccacaggtggattatccattcatgtgttcatagatacttgggacatttgtactttttagctatttttgaataaagctggtatgaacaactttgtacagttttggacagaagttttcatttctttgtgataaatgtccaagagtccaattgctcttttggtaagtatggctttaacttttcagaaaactgccacacttttttcttatgtggttgcacagttttactttctcaccaccagtgtatgagaattgcaattgctccacattctttctcaacacttcttgtgggcagaattttttttagccatagtagtgggtatgtagtggtatctcattgtggctttagtttgcattttcatggtaacagtgatgttgagcatcttttcatttgcttattggccacctctattgtttgttgtgaagtgtctctttaaactttttgcccacttaaaaaattgaatttcaaccattgcggaaagcagtagggcaataccttaaagagctagaagcagaactaccattcgacccagcaatcccattactggttatatactcagaggaatataaatcattctaccataaagacgtatgcactcagatgttcattgcagcactattcataatagcaaagacatggaatcaacctaaatgcccatcaatgacagattggataaagaaaatgtggtacagactaggtgtggtggctcacacctgtaatcccagcattttgaaaggccaaggcaggaagatcgcttgagtccaggagttcgagaccaacctgggcaacatgaagaaaccctatctctataaaaaatatgaaaaattagccaggtgtgatggcatgtgcctgtaatcccagctactcaggaggcagaggtgggagaatcacctgagcccagaagtcagggctgcagtgagccctgatcacgctgctgaactttatcttctctagagaatatgtagtactttaggtaacaaggttatatgtacaaggctagaaaacaactacttgtggtgcgttgtaagtgctttatagataatgcatcttttgggaattttgagcaccaccaagacgtttgtgtatttaggaaaatattttacaatggtgacattgatttcaagaaaaggaaatgaggcatttcaataaacatcggttactataagtaagtgaaactttttctcttttctttttttatgctttaccacttaaaaaagaagagcaactgatagctaatttggattgttactttttctaattatagattgacaagaaagtgtacttttatctgactgtatttaattagagaatttatgagtcagtctttgtaggcaaagcaggatatagttacaatagaaaataaattgtttattctatgtaatttttaatcagattacacagcattttcttagaagggagcaaatccatgttctaatttccttttgaatgggaaaaatatctctttaataaaaaagaaatctgcttacatctgtcagtgctttttaaaaaactttatctggtgttttattaatctggaatgacaaattggacctacatttatttttatttgctcaaccttttccaacgaatgccatgactcagatgctcatattaaaatctttggaaagccacatctcatatgccgttgtatgagtgaaactaaatgcaagtctgtgctcttggaagtaaattttctagttagtgccctgaatccaggggaaataaatggagacacttcacagcaattcagagcaaaaactccctttcttgtatctttaaacagaattaaagatgatgcagcaaaatctgtggtaatgccatgataagtttgcaccctcactactacccattccctggatcccatccacttcaagtaaatctctagggcagtcgatttcaaagtatgatccctggaccaacagcatgggtctcaccagggaagtcattcgaaatgcagattctttggccctactccacacctgctgaatcagaaacttaaattggaaggcacggatgggagtggggtgcagcaatctatgttttaacaagccttctaggtgattctgaagcagccaagtttgagagccactgttctaggggagtgaagtaagttgttacagacctatataaaattcatttcttgcagcttcaagctgaaaggtttattaccaggttgctgtagcaacaactgcacagtaggattggataatgaaacattgtgaaattaagaggcatgaatattagctgatcccaatattctagattgctaaaatttatattgggcaaaatggatttttacttttagccttatggcaggaagaagcatggtttcataaaatgttatgtttgacaagtggaaaccacgactattttttgaatactactcctttggaatttagccaagtttttgtagaaaaagggaattactcttaaatacattcatcatggaaatcaaaaggtaacatactcagcagtgacttataaccctgaaagagttaatttttaattgaatatttctaatacattatagtagctttatttgcctactatatgtttcacaaagcacagtgctatgcacctagtggtattaagtaaacaataagaattttttgttaaacccttatttggtaattatatgccccaaaaatagttattttaaaaatatattcatattctgcttgctttcctctagtgtatggtctaaaatccagtactttctgtattcagagaattaaattcatgttagagtttgcattttattgatatgtgctaaggattagatgcactcagttaagctccttcccagccaaatgacatatcctgtctctgatgtcagtctgagaaaatcctgtatggtgtactacatctccggattaccttatctaagtattacatggacatttcagatgatatgtcttggcatgtggtcatttttcattaacttattagcaattgttaaatcatcttttcccctttttgacaccttgctataactgaatgtaaaattgactgtaagactgaatgcctgatattcatgcagtaagttgatggggcatcgttgttgtataccagaaaccatgcctacatgggtgttttaggaaaaagggctctgttgctatctgatgtgagctatgaaaaaataatatctatcctctggagtttattttcctcaactataaaaagaaggaattcgttgcatcatctttaaggttctgaaaattttataactctaagatctagggggaaaggagaggaaatccaatccatgaaccactgccaaggtacaatatatgactaaatttttgtgtgtatttattggaaaaaaatgaattacatagaataattagcataaagtcagccttgaactccgttaaaatcaatggaaaataatgatattaggtactgatgatttagagtttaaattaacatgttttaggaaaaatactttagaaaagtgcatttgaacttaatgcttttttctcagagttttcacattgaattatttattcttaaatccaatgtgtatggaatacttagaaaagcaaatcattttaatattttaagcataggtacactctgcagatcatatatattcttcctagaaaagaaatatcttttaaaggacacctctctacactttatactcctctgcactcacttatttcattacattttgtgaaacctaaaattgtagctatagaactattttgggcgcgctttttccagaaccttgtaagaatcaacaggagcataattttaagctacagaagtgcaaaataagcacagagtcctagctaccatgaataaaaggccagaattctaacttgcaaaaacacgtaattactaccaatgggggagaggggaatgagaacaaaaagtagaattttctgggggatttcttcatacttctaaacgttttctctgaactttgtttcttctcagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtaataaactacttgaattgtttaagtaaaacacagaaagaatgcagtttttagcctttgctttgttctccttccctatatctgcccttctttcatttaatatgcagaatggaaatacaagttagcagggactcatggacaaggcatgcacctaagtatctggcaaatagacatttatttataataacagacaaaatacttttcattttcggtgagcccccaagggaaataatctcatgtaatccataatatcgtgcatgttttgtttattactcaccttttattttcatctttattttccacggcaatactagtagaatttattatagaatgtccaaatttcatgtattttggctttatatcaataaatgaacagtgagatgaacagttgtgtagcaagcatattctgtatgtgcttactatttggattcagattaacctgttgaatgtacaaacgcaaattaaccaggttggactgaagtggtttaaaaaaccagaaggtgaatgaacatcatccatttgcttgacaataaggactagcagcagtatcattatgtcataatcatatatgattttcttgcaacttttataaaaggaaaattttgtctttttgatttgttggaaaggggttaatttattttatttctgttcttttgctcctaccagagaacaaaatcttttcataaaaagcacattactgcttattaaacacattagtctctccatcattctgtttgtgtacattttataagtccccattaccatgaccacaaggcttactctgttaacagtggtaattagtactttttcaggtggcagagagatagccagctgccctgtacctgcagtttgttttttctattttgtcctcttctgcctcctttaatccaaaggtgatactggccatataatcaggaattagaggttgcctactagttagaatatcacgtcctaaatagtagaccataacactttacaatatcaccaagtatccttggggtcttgattttttttagattattttcatatatgtatgtgttcatgtatgcattgttgactttggccaagagtataggaagtaacgtacggaaatgagaggggaacatatttgacatatgtagcatattcatgtaagtgaaaggcattaggatagaagttaggagacctttgactggtcactacagttttctgggtttcgtctttcagttgggaaaaacaatgatcaaaattatatgaaatggggtggtaggtgatctcttatattggcaagacatcttctccttcatctcactctggacatattcactgggttgaaacattaaaatgaaagaagtttccccactgggctctgctattcttctacctttgcaagtctcttgttatgaggtatcttttggggtgatgaaaatattctagacttagatagatgtgatggttgtgcaactctgcaaaaatactaaaaaccactgaattgtatgctttaaaaggatgaatattacatatgtgaattatattgcaataaagctgggttttttttaagcaccactagatgaagggtaagggttgaagtttgaggaattgcagatgacttggacaaggcttaactagtgaaatgtttactgttacaggtttcaaattctctcctgtttgttgtgacatggaggctcaagctgggtctactcaaggcaagtgttttcaaatatttgatcacaaattatttttacttcaccccatccctggcaccctacccccacaaaatggaaccctgcttctctgacaaacaacatacaagcctgctcaatgaacctgtcagagaatacagtggcagcttatttgtttgttttcttcttgaaaatttcatgtgaaaatgttggtggtgaagaggaggtgaagggggagctagggagaaggataaaacaggattccaggtaggatgagaaaacatttatttaacctgggaggagagactgaaatcaggttgggttggatttggcttcatgactttctacaaatctaccatgttttacatggctctcataattaactcagtatagtttaggtattgtcataactttcagatgttgcctagcagttggccttggtctcttcctccaggtgttcatgcttggctttagcatcacactttatccatgtcatcaatcataaataacactttcaaatgaaaaaaaaatgttcattctcttctgtaaacctatatttacactgtgtcattccttagtaagggggcattggtgtatatttttacttttgccttcattgtgttcattgggttttgcccctttggagagggatactactgaaagtaacatttataaatggttttcacaactgggcctgtgctgggcccttctctaacacctcgtggtagggtccaagcatcccaccacagggcagtgactcaaaaatgggatgaaactagtatataaggatttagaacagtgtttttaacatgtaggaagaatatgaatgttcactgttattattggattagcatttcaaaatttccaaacacacttttcatatctttatcccatttcatccttatgaccactctgtgaaacaaattctattatttccattttacatatgaggaagtattaaaacagcaattcagaaacaatctagttgaatgcaatggattattttccaagtatgctttgctttctcctttggatcatgtgtgtatgcaatatgtaaacttgaacaacttttccctgctctgttctgtatgtcttactttgactcctactaatattttcaataaggagtatataatttgggtccttatttatcacctatggtaagattttaccaatgtggattccacagattttaattgatgacaaccatgcctggcctgccttcagcatttccatagatccttgaggagttggtttgagttaagataagagtgtaaatggcttttccaaaagcatgttaatttgaggaaacaagttatttccaatgaatgaacttggtgtttgtgtggaaatgttgctatttatttcccattgactttatccattcatgaaagcatgcttatcaaggcatctattttattaatttgagtttatacatgttatatctgaaaaagtaaaactacttagaatattttttatgtatatgttttgctacctcagactccatgccagcccatccctgtggctcaattaatgttaatgacattttgttttgtttctgtcttcatatactttctgaattttagattatcgatgaggcagtgggcatgatatcatggatcagcttaggaacatttgagcctcacttgctctgaatgttagaaaaagtgaagatggaggaaattgttaatttaggtgaattgtccaactgagaaatattctgagaagtaatttcaaagatgcttactattctattcatcctaggagaatattactttggttttctacttacatttccaaaatcatgtttataaggacttgtttcttttatttcattaattggccaagcctttcagaatttttttcctcatttccttaactctgtttggttgcccttaattgaatttatgtctctgacattttataactcatgaaggattataagaaataacccttaatttcaacactaaaacacttgaacttaaaggcctgaagtactggaagggaaatcatcaggtgacagaaggggatctggagcctttcacaggggtatcagagcactaatgcattatgtttccattctctcaaatttgtcctaagtaaacccttcatcatctgttgatgctgaattgtctgtcaagaaagatgcagattcattcaagttagcttcattctgggacctgtgaacagtcaatacctaggtgatactttgatatcaaccatcatgctttattctatgtcatttttattcccatttcaccttactaacaacattactactcttcatagactaatactagagttgtgtattttatatcctaacaatcattgttaataagcactagactggaagctacttgaagaaagggtctaatttattcacttttgtagcttcagtacttagcaaggggacctagagcacagtaggcactaaataaatgaaaaatatgcattgttctaagggtaaaatatattttttgttgatcttgtcttgtgtgactctcataaggataaaagtgctacagtgtgtcagacctctggtcatctaatatacaactctgtctctgacaggtgatctaatggtcatttaatttttttatctttagttatgggtacataataggtgtacatatttatgggtacatgtgatttttttttttttttgacagagtcttgctctgtagccaggctggagtgcagtggtgcgatcgtggctcactgcaacctctgcctcctgggttcaaatgattctcctgcctcagcctcccaagtaactgggactacaggtgcacaccaccacatccagctaactttcgtatttttagtttagacaaggtttcaccacgttggccaggatggtctcaatctcttgacctcgtgatctgcctgcctcggcctcccaaagtgctggggttacaacatgtgatgttttgatacaggcatacaatgtgtaatcagggtaattagggtatccatcacctcaagcatttatcatttctttgttaggaacattcctattccaatattttagttattttaaaatatatgatgttaacattgactacagtcaccctgttgtgctatcaaatgctagatcttattcattctatcttactatatttttgcacctattaaccttccccaccttttcccccacttccctctacccttttcagcccctggtaaccatccttctactctctatctccgtaagtacaattgttttgatttttagttcccacaaatcagtaagaagatgacgtttgtctttctgtgcctgacttatttcacttgacataatatcttccaattccattcatgttgttgcaaatgacaagatttcattcttttaatggctgaataatattatattatgtatatgtactacgttttctttatctattcatctgttgatggacatttaggttgcttccatgtcttggctattgtaaatagtgctatgatatgtttcctttcttttgcatgtatacatagtagtgggattgctagagcatatggtagttctatttttagttttttttagggtacctccatactgctcttcatggtgactgtactaaattacattcccaccgacagtatataagtgttcccatttctccacatccttgccagcatttgttattgcctgtcttttgggtaaaagccattgtaactggggtgagatgctatctcattgtagttttgatttgcaggtctctgatggttaatgatgttgagcattttgtcatatacctgttggccattcatgtgtcttcttctgagaaatgtctattcttttgcccattttaaaatcagattatttaatttttgtttcctattgagttgtttgagcttcttatacattctggtattaatcccttgtcagatgggtagtttgcaaatattttctcccatctttactttctaataagcatttcttagaagactttgacagtcctacttaagtatcaacctcagtgattagggtacccctcagcagttacatttggctacacattgaactggaggaaaaaacagtatcaacagctaaatttgaataatcaatttccaagaatgtgtttttcacatgtggcctgaatggaacagttgaactataaaatgtgaaaataaaaattgtttatcaagaagctaaatggaaacacattttctaggtagtgaaaaagtattgtaatctttaataaaatataaattgcaaataaattatttatagttatagccttgatgataatgatatttctgttcaagaaatatttattaagcaccttctctttgccaaactgtgtactagagattgggaatatatgaaagatgaataacacacattccccaatgtcaaggaatttaccgtctactgggagagattgatgccctattagttaagatcgcctattatgggtaacaggaatcaacttgagctagcttaaactgaaaacaattgtattaaaagtacataagaatacaaggtgactgtagtcagtaatagtctgattgtacattttaatataactaaaatagtgaaatatgatcagttgtaatacaaaggataaatgcttgagaggatggatacctcattttatatgatgtgattaatatgcattgcaggcctatatcaaaacatctcatgtaccccataaatatatatacctactaggtacccacaagaaatacaatttaaaaaaataaagtacgtgagaatgctccattggactcagggcaagagtgtggctataccacaagaagggacttgttgcagtcccttaacaattctcagaagaattgttaagaccttgctttttgttttgaaacccatctccttcaacactgtctctgcaggttgagtttctctaagtttccatctacaggacaggtataaaaaccccataccccataaaaccttagttcatatttcttctattcaggaaagaagctaagattaaccagattttttttagtgccatttctaaattccaaggagacagaataattttctcaacttgagtcagctgtctaccactggtctcatcagctacaatgaggggtaaggtcagtaatacaaatgttgctttctggaagcctacccaattgattctcgaagcaattcccaatgcagggctgtcagtgtcaaatggatatgtatacccaaagaggtctactagagaggattgaaagctaattttaatacactttagttaataccatgataaagatacggtagcttgctctgagagcacaagggatgtgaaaccatttagtaacgtaaaagtggtaatattaatacaatataaataaacaacgttttctgtatagtaagtggttaagaataaccacgatgtaagacagacctaggtttttgcactagttctgccatttacctgctatatgtccttggacaggtaactaaagatctccaagtcttagtttctttatctgtcaaatggtgactgcaaagtcttgggagtttttgtggtgaggattaaatgagaaaatggatatatagcactttacagtgtgtctgttaaaatgaaatgctctataaatgtcagttgtggttgttgtttatcactattaatttattatgcacgtattatgggacagatgctatcaggtaaggtacctgttatcacgtattagacaaagaggcagcatagcttctgaaacacctaatatcccagggaactctttagcctagcagaacccagcctactttctgctcattttaaagtaggtaaaaatccttgcacttgtcttattttaaataatacaacattttattaataggcaacaaccttgttctgctaaacttagaagactgtgagaggaagttccctgaggcacttcagacctggctgcaggttaacttgtgctgttgtatttcccgttgtcattgtagtaaccctttaagggagaggtgggattttaattagtactcagaagtcctgttgatttccttgactgttgggcggctgagctccctatgttgttctgttcagcaactttacaggtaagggaatatctgatacaatctcataacagccaagaaatccattagtactgctccctgttgcttctgtactgcataccacagaacctaagtagtgcggtatgtgctaccaataaacataccatcatagccatgcatatgctgttctcagaccctaaattcattcaaggaaaccgctggagttgtgaaaaaaatggctagcctaatgcctgggtttcttgaatgacatgtaatagttatacccaaatgatgagttatttcttctgatatttgaccatgtacatttgatggagggaatttgtttgtttgttttccatttctttcctttgctttttttttgttttcccctggtagtgtaagttatataggacccttacatagcagtgataacaattcctcagaaaccatctgattgctaaaggaagtgtatgaaacaatgcaatgacttggtaatagcttcagcaggagccctgccatataactgacatcctaatggctctgttggacccattaggcgtgtgtgagacagtgcagttgactctgtaacagctcctttggagatgttacactatcagaggaagtgtggaagtgattgggattactttatgtgtgggtgagacacttctgtggtgactgtgatattcaaaattaaaaaccactttgatgatactgaatttcaagccattatcaaggtagatataacaagctcatattttctttttcagtaggtaattttagctactattatctttatgttaaagtaatattggccagtgatttaaaaattaatagtaaaaacaggtttaaagtgaataaagtgtatcatccccctccctctccatccttcaggtttcactcttgagacacagtcaggttaataatgtattatatataattccccaaattttccacgcatgtacaaatgggatcacatactacaaaaagtctcataattttttccagttcatattatcttggatatttccccatatttgtagtacaaatctgcctcgtcatttttaatgactgcataggattctgtttatatatgtgttattttttttagccagtcccttgttgatggacatctagatttccagtgttttgatattaaaaacagtgctgcacttaatatccttgtacacatcttttacacacctcttgtataatttattagaagtagaaatgatgggttgaaaatatatgcatttaatgtttgtttagatattaccaaatttcccccttaaaaaagacctaccaatttatttacctactaaagctatataaaagtgcctgttttcccatatacttatcaacactggcaatgatgagaaagatttctaatacccaatctgcaatatgaaatacagtatttcttcttgctattatttgttctatttatgggtgaccttggtcatctttttaatgttaatggcccatttccatctcttctctcaatttcctgttgacatactttgcccactttcccatatgaatttttatattttcttattagttctctagagtacttcctatattaagggtaaaaaaaaaaaaaaaaaaaaaccttcactacatattatgcatttttcctagtgtgatatttgtctttttaagtaggtgcattgtgtgtgtgttgtgtgtgtgtgtatatgataagatttacatttttaagtggtaaaagtcaactatttgtactttatagctggtggatctctctctctctctctctctctctctctctctatatatatatatatatatatatatatgtatatgtttttgctagcagtactataatttccacaatttgaaaaataaattgcttaaaaatttaatttaaaaacagaatataaatatctacacataaataataaatgtgaatgtatggtatgcatatgtgtaatatataatacatacatatggatatatttacatgaaagcaaacttgaatgtagaagttaaatacagtacaaataacgtagctattaaaattaattagtattttagaagttagtctttggagttgatcttgatatattatttactctcttacttctttagtatattactgtgaaagaagccaaaatgagttaaagtgctcttatcaacagagttttaaaaaagagcttagaaaatgaaggaaaaaaatatggctgagcctatattcaccagaaataaaatgacaacattgtcatctgaatttgaaaataatgtttcaattgccatagttaggacttatgcttttggttgttcttttctggtttgggaatgggctcatgttaagtcattcgtgttaccttgcactgtccatcttttcacttttgatagatattcatgagattgctggtcagagttaattttttgggtaggtatttaaagtggaatgcagaatagctcacaatttgaatgtgtgcagttgaatttgttttcatatatcctagttgatcattttttgaaataattgaaataatatctttagagaaaaggggaatcatcttggctacttcagaggcaagttgactatcttttcagtagtttttttgttataaaagtaatattttttaataaatagattattaaagaaaattgggaaattactgaaaaacaggaaaaaatccttaaggttctctccaaaataaaatattagtcatattctctcatgaattagcatcttacctttttctttccgtgcatcatgtgtccttatcaggatccatacaacctgatatttcacttaaattaaaatgtgagcaatttccaatattactaagtcttaattaaatgttattttaaatatattaattaggtagatgtaacataattaactatacactatttttgaatattaacatttccagtatttcactagagcaaaaagactaaaatagacatctttgtaatcaaagataggtctctttctgatctattcattattagtagagttctacaaataaaattactgggttctaaaatattttcattaaagttcaagatatatattatcaaattatatcaagattcatactcccccattagtaaagcatgatagtggccattttagtgtaccctcactgatactagataatttactttaaaatatttttcaccaatttgaaatgtgaaaaatataactacagtcatgtgctgtataagagtgttttggtcaatgacagaccatatatatgagaatggtcccataatataataataccatatttttactgtaccttttctacatttagatatatttagatgcataaatacttagcattgtgttataattgcctacaatattcggtgaagtattaataacatgcttacaggtttgtagcctagcaacaataggctacacctatggcctaggtgtgtagtaggctataccatccaggtttgtgtaagtacaatctgtgatgtttgcacaatgacaaaatcccctaacgacacatttctcaaattgtatccgtgtcgttaagaaatgcatgactgtatgttgtttaaaattacatgtcattagagagagaaaggaagctagctgactagaggcatctggtacttacctcctccacaaagaagaaccaaaatagctagtaatcacacttcaaatacatcatctatgggagaatgctagaattcagcaaagaagtgacaggaagtacctaaggcaaggaaaaagagggaagcaaggcagcctgctcagctggaatgggctggggacctggaaaagatccccaatatgatgaaaggataagtgagagaccccagcagtctcactgtgaactcctgcagtcctagctatggagaacccttgatccatgtgggccctgagactaacatagggaatatgcctggagattatgtgacggcattgctccagagagagatgtcacattgggtctcaccccccacccacccccaaatcctaaacagctacagcatgacaccattttgagagctcggtctccaatagacagcatcctgccctgggggtcaacatcctctgcctctacacatccctggagtacaatgaacatcctctgcctacagccaccaccgcagctggctgctgctaccagggtcaaagtatgagccattggaagcaaccccactgcccccagcagtggagcctcttgcatttgcaagcaccctaatgacaggctaccctgctgtagctactacccagggcaaaagtgcacactccctacctgcctgacaattgctgctgccactgaaaacaacctgtggctccctgatatcagggacacagtgcagccactgatacccctacccaagcattccaccagaggtctgggatcaccctacccctgccgaccacagtcagcacctgcatgcaccacaagaggaggcccttaatacagatctgcctggcccagcaccaccactaccagtgtccaagctcattgtccaggagagtgaggattgcctgctcagtccaccagtgttgacaactgagcactcctcccagaagcctcaagttgggccaacacaaccagttgataccaccaaagcttgtacccgtcagcatgcaccacctacagacctgggaattggcctgtccaacctgccacagccactgccaacacaagcacagatcacttggaaaatagaaggttgtcttgtcactgctactgctactgtccatgccacacctgctggccagcagcccaagggcccacccactcacttggtccactgctgcaattgccagcacttgagcaagctttctggaaacccaatgatcaacctgcctggacccactaagactggtgccagcatgcactgccttgaatgggcccaagaacaggcacacttggcctgccactgccaccactgcagctcaaggaggggcccagctggcatcctcatctgcagcaaaactttgctttagccttcactaaaaactgcacactaagccactgaggacatcatagacactactgatgttgtttacagctaaaggagtcacacagagatgacactacggcacggcacccagaagcaaagcaaaaattttctacccaaccaacatataggtatgtgttcaggaaaaagtcctcccctaccaaagcaaatacaaaaaaattagaaggagcaactgttatacctgatgcacaaatatcaatgttaaggacaaaagaaacattaaaaagcaagaaaatatgatacctcaaaagaacacaataattatctatcaacagattctaatgaaaaaataatttatgaaatcctgggaaaataatgatattaaattcagtgagacaaaaaattaaattaaattaaaaacccaggaatacagctaaacaaggaggtgaaagatctctacaatgagaattaaaaacactgctgaaagaaatcagagatgacacaaacaaatggaaaaatgttccatgctcatggataggaagaatcaatattgttaaaatggccatactgcccaaagcagttttacagattcagtgctgttcctgtcaaactaccaatgacatgtttcacagaattaggaaaaaaactatgccaaaatttatatggaaccaaaaaagagccagagtagccaaagcaatcctaatgaagctggaggcatcacattactcatatcagagaaaatagatttatgtcaaaaatactaaaaatagacaaaaatgtcatcatataatgataaagcaatcactttagcgagaattatgtaacaattctaaacatatatgccgccaataccaaagcactcagatgtataaagcaaatattattagacctaagaagggagatagactacatagattaatagttgatagactacatatgttaatagttgacttagacaccccactctcagcattagacagatcatctagagagaaaattaacaaagaaacatgggacttaaacttccctttacaccaaataggcctaacagacatctacagaacatttcatccaacagatacagaatacacattcttcttatcagcacatgtaacattctccaggatagaccacatgttaggacacaaaacacgactcaacaagtttttaaaaatcaacatcatatcaagtatcttcttatactacagtggaattaaactagaaatcagtaacaaaaggaactttggaaattgtacaaatatatggaaattaaatatcctccttaatgaccattgagtcaaacaagaaattaaggaggaaattttaaaaaatctcttcacacaaatgaaaactaaaacacaatatagcaaaacctaaggggttgctgggcttggtggttcacacctgtaatcccagcacttcgggaggccgaagtgggcgggtcacctgaggtccggagtttgaggccagcctggccgacacagtgaaaccctgtctctgctaaaaatacaaaaattagccgggcatggtggcaggtgcctgtaatcccagctactccagagactgaggcagaataactgcttgaacctgggaggcagaggttgcaatgagccaagattgagccattgcactccagcctaagtgacagaacaaaactctgtctaaaaaaaaaaaacaaaacaaaacaacaacaacaacaacaacaacaaaaactatgggatacagcaaaagcagtgttaagaaggaagtttatgggaaaaaaatgcgcacatcaaaaaagtagaaagatgtcaaacaacctaatcaggcaccccaaagaattagaaaagcaagaacatactaaaccccaaattagtagaaagaacacaataataaagatcagaacagaactaaatgaaatatggactataaaaagtaatacaaaggaacaacaaatgaaaagtaggttcagcagataaacaaaatcaataaaccattaaccaaaaaaaaagagagtagacccaagtaaataaaaccagaagtgaaaaaagagacataacaaaaactgatatcatagaaatgcaaaaggtcatcagagactgtcatgaacaactatacactaacaaactggataacgttgaggaaatggataaattcctggccacatacaccctaccaagattgaatcaggaaaatatagaaaacctgaacagatcaaaaatgagtaatgagattgaatcagtaataaaatgtttcccaacagagaaaagttcaggacagaatggtttcactgacaatttttaccgaaccttctaagaactaacaccaattctcctcaaactatttcaaaaagttgaagaaggtggaattctccctaactcatcctacaaggccagcattaccctgatactaaaaccacgaaagtcacaatttaaaaagaaagctataggccaatatccctgatgaatatacatgcaaaaatcatcaagaaaacatcaacaaaacaagtctaataccacatcaaaacataatataccatgattcagtgggatttatcccagaggtgcaaagatggttcaatatatgcaaatcaataaacataatacatcacatcaacagaatgaaggacaaaaaccatatggacatctcaatagatgtagaaaagcatttgataaaattcaacattcccctcatgataaaaaattaaaaacctctcaaaaaacaaggcatagaaggaacacacctcaacataataaaggttatatatgacagacccacagctgacatcatactgaatagggaaaagctgaaagccttttctttaagaactggaagaagacaaagatacccagtttcaccactcctgtttatcatagtactggaagtcctagccagaacaatcaggcaagagaaagaaataaaaggcatctaatttgaaaaagaagtagtcaaatgttctgtctttgcagatgatattatcttatacttagaaaatccttaagacgtcaacaaaaaactcttagatttgataaattcagtaaagttgcaggatacagaatcagtttgcaaaaattagtagcattgttatacatcagtaatgaactagctgaggaaaaatcaagaaaacaatttcatttgcaatagctccaaaaaaataagtacctagaaataaattgaaccaaggcactgaaagaccactaccaagaaaactaccaaatcactgatgaaagaaattgaagaggacacaaacaggtggaaagacatccgatgctcatgaataggaagaattaatatagtgcccaacacaatctacagattcaatgcaatccttatgaaaatgccactgtcatttttcacagaaatagaaaaaatcctaaaattcttaagtaaccaaaaaaagcctgagtagccaaagcaagtttgagcaaaaagaacaaagctggaagcatcacacttcctgacttcaaaatttattacaagaccatagtaaccaaaacagcatggtattggtataaaaacagacacatagaccaattgaaaagaatagagaacccagacataaatccacatatcatcaggtagatacaaatcaaaatgaaatataatcttatcccacttatcacagctgttattaaaaagacaaaaaatagcagatgctgacaaggtcgaggagaaaagggaactcttacacactgttggtgggaatgttaattagtataaccactattgaaagcaatatggagatttctcaacaaactaaaaatagaactactataggatccagcattcccactcttgggcatttatccacaggaaaagaaatcggtatatcaaagggacacctgcactcccatgattattgcagcactattcacaatagccaagatgtggaatcaacctaagtgtccatcagtggatgagtggataaagaaaatgtggtacatatatatgatggaatattattcagccataaaaagaataaaatcctgtcatctgcagcaacatggaactggacatcattatgctaagtgaaataagccagacacagaataaaaaatgatatatgttctcacccatatgtggaggtttaaaagttgatctcatggagatggagtttagaatgatagataccagaggatgggaaggagatatggggaaagatcaagaaaggtttattaacggttacaaagatactgttagatagaaggaaaaatttctaatgttcaatagcagagtaggatgattacagttaacagcaatgtattgtatatttcaaaatacctggaagagaggacttgaaatgttcccaacacatagaaatgataaatactcaacatgatggatacccccaaatacactgattggatcactgcacattctatgcatgtaacaacatatcacatgtatcccataaatatgaaaattttatttctcaataaaaacatttaaaaaaataaatgtcatccagaagaaaattcagaagctataaaaatattaatcaagcctggcagccttgaggaacactttaagaggacagaaaggcttagattgtttagttgtttctggtcttccgtgagccagccttcactctgcagctcatccttggccatgaggggatgacaacttgtagggttaggcacctaggacactagccccatctaaatcagttatatttgtctgtgtgtctgtttttgttgctataaagatacctgaggctgggtaatttacaaagaaaagaggtttatttgacatatggttcttcaggctgtacatgcatggcatctgcatctgcttggcttctcatgaggcctcaggaagcttttagtcatggcaaagtggaaggggagctagagtgtcacatgccagaagagagtaagagagggatgcctggctcattaaaataaccagatctcatgtgaactcatgaccaccgggagggcaccaagccattcgtgagagatccactctcataacccaaatacctccctataggcaccacctccaacactggggatcacattttaacatgagatttggaggggacaaatatgcaaaactatatgatcagttctccagtttgactctggatccccaccctcagacctctggatgagattgttcctcctctatagttctgtggttctctggactagcctcgtcatagctgcatcacactgggctttaattgtaagtatcccccaactagattgaaataaaacaagctgatcacagatgtatgtaaagaaattttggcccaaggtaaaaactcattaaatgtgtgaagcatgaacatatagttggcccttgaacaacaaagttttgaactgcacaggggtccacttatacatacattttcttctgccttggccatccctgagacagcaagatcagttcctcctctttctcctcagcatactcaacatgaagatgaagatgaagacctttatgatgattcacttccacttaattaatagtaaatatattttatcttccttatgattttcttgataacattttcttttttctagcttactttattgtaagaattaagtatataatacatataacatacaaaatatgtgttaatcaattgtttgttattggcaagtcttccactcaacagcagaccactagtagttatgtttttggggagtcaaaaattatgcatggatttctgactgtgtggtagtcggcatctctaacccctgcactgctcaagcgtcagctgtactaataaacctataaataaatcagttccaagaagttctatgaatgggtttcagagagtctgtgaatgcctcaaattgcatgtaatattgaatgcactctgatagatatgcagtcctctggcaaggatccatgtccttcattagattataaagtagtccatgactacctccaaatacccccaaattatcttaaattccttgaatgagtatgtgggccaagctttgaggtaccagtcactttcagaagtcacaacttatattctagagagagtttattttgttttggaaaaataagcactgttaggaaccaatggaaaatgattaacctctttcaagtcaggggttgaaagttaaaagagcagaatatcattacttaccaactgcagccaaaaaattacaaatgaaaatcaactgccactgcaattaatactttgtctctatgaatgggtaacatggtcacctctgtggaggaaagtggaaatctgaagatctgcagtgcgttaattgaacaaatattctttctctgaatgctatattgtataatttggaattttttcctctgtatgatcacctatttcaaaataaataattataattttttaactggatgtcctttattgattctggaatttaacaatttttataatgactttaaattttcgtttgaactggaatgattttttaaggaaactatgataaaatctgagaactaactaataaattcaagaaccaattcttataggcataagcagtaaaatagcagaatcaggaaaagaagagaaaataagacgtgagtatgtcgaaataactaaagagacagaggatattgaatgattcataagagaccaatttgtgcacctcttttaaggtacccttgaaaaccatgttggaatggataatctcatagaaaaaatacaaatgactaaaactggtctcagaagggagagaaaattttctcagtagagaaagaaatctgatttgtaaaatagaaataaaacttccaaagaactacttaaaccaaaagaagtagcgtaattaggcagtgtcacaggcaaaatttgctacatctttaaggaacacattatttcaatgctacttaaatgttttaacagcataattaaatgaaagcttccaaatcttttaaagatttttttggaagcaaaaaaaattgatatctaaaagttaaaaaaggaaagtacgaaataaatcttcaaatcaattttacttctgaataccgaagcaaaattcttaaataaaatactagcccacaaggtccagcaatataacagaaaaataatacactacaagtaagtgcagttcatactaagaatgcaaggattattcaatattaaaaactctgttactctaacataccatatgagtacatcaatgtagataaaccaaatttaaaaacggcggagattttcaaaagggttttgataaaaaccaacattttatttaacaaatgtgtttattctgtgccaaacattgctctaagtattttacaaatattgagtttaatattcataaccgctccataactgaggtacaaatgatattcccatttacgatgagaaaactaaggcacaataaggatacataaaatgatttggctggtaagtggtaaagtcagtatttacaccaggcagttcaatccttgcatttacccatgatattatactgtctgtcatgcatcaatttttgatagacatacatacaaacgtatatatatatatataatttcttagaataagatcatgtaaaatcacaaaatccagttttatttgaagtgaggaagcactagaaggattttttttttttttttttttgagacagtctcactcagtttctcaggttggagtacagtcatgagatcatggctcactgcagctttgacctcctaagctcaagtgatcctcccactttagcctccggagtagctgaggctaaaggtgtatgccaccatgccatggctgtttaaaaaaaaattttgtagagaatggatgtcccctttgttgaccaggctggtgagctcctgagctcaagccattctcccaccttggcctcccaaagtgctgggattacagttgtgagccaccacacctggctctagaaggatttctattagagacaagaacaaaacaaggatatccgctctaattaactactttaaacttatgaagtagcaactgtccacattagaaaatagaagaggaataaaattagaaaaatgaggtataattttattatttttaggttatataattgtatatctaaaaaaaaaaaatctaagaccaaacatgaaactaatacaagaaataagagaatttagtaagctagttgggtataaaattagcacaccaaattaatagtttccttccatacaaacaatacttacttagaaaatatagttgaataaatgattacagtagcaacaacagcaatcaaaatgcctgagaataaacaagcaaaaagtacaacacacacacacaaaaatcataatgctattgaggaatatagaaaagaacataaataagtagaaagccatacttttttcttaaataagtctcagaaccataaaaattccccttaatctatcattttaacatgccttcaataacaaaatatcaattggtcttataaaaagcctaacataccagctctaatattcaactgggaaaaacaaacataagaatactttgaaaatatatggggaaaaacataatataatgatgatagatttgccagatattaaaatatatttaagttcattgtaaataaattagcggggtgctattatatgaataaacaaagtgttaggatggaagaagactggaaatggttccaaatacaaacaggagtacagtatatgataaagatgacctttcaaataagtctggaaggcataaattgtttatgaaaagtgttgagacaattatgtagccatgcagaaaacaataaagttgcttccctccgtacctcactccctacaccagaataaattctaggtgacccaaaattaaatgtgaaaataagtactataaagcaatatgggagaatttcttccaaccttaaagtaggaaaaccttttctagatatagcccaaaaaactagaagccataaataaaactgctgtcaaatttgactacacaaaattatatacatatgtatatatatgtatattaaaatatgtgtagcatacagagacagtcaatttcctcctatataaagagtgcttataatcaataagaaaaaaatccaaataatgtaatagaaaaaaattgatatatgccatagtaaaggaaatgagaatggttcttggacatatgaaaaaaaatgtttaaactcactcctaagagaaatgcatattaaaactgaactaaattttatcatttatcacctataatattggcaataattaaaattttataacatacatttttggaaaatgtgtatgaaatattgattatggaagtaaaaatagatacagtcgatatgaaaagatatttgacaatatctagcaaagacaaattatcttctttgatccagcagtttctcttcttgaaatttatcctacagatattgaatgagcatgcagtggtatgtatgaagatattcacttagcactgtttgaaatatcaaaaaatcagtgatatcaatcaagatgtttatcaataggaagccacttgaataatttatggtataataatttgagtaatttatgcagtggaatactctgcagccttaaagagaataagacatataagtaggaagaaaagttgggtggctcaagcggaattgcacagggggttttaactccattgacactatttgtatatgtatttatttatgatattttatttcttaagctcagtaatggggtacatggtgattataatattgctctttatacccttttatgggtgtctgaaatttttaaaataaatctagcacaaacaaaatgagacaactctgtatttattgaagttgaacagtcttcaagatgcatcattaaacaaaagccacagggtttgaatcgttgtcgatagtagtggattttcttgtctatgacccagttgaagaaatatattttacattctaacccagttcacaatgaatccataaataaagaacaaaaacaaaaatttcataagacgatatctacccttactatgaaacaacatgctctgacattttctcttctattcgattccatttcatatctatgtaatgttaattgtgatccagtaaattcattttataactaatagatcacaacctgaagtttgaaaatgatgatgtccactgtgctacactttatgtgtgatttttaatgaagctatatgcttgcatgcttacattatcatagaatttctctgaaaatattcacaataaatgaataattttgattgcatttgtggagaggaagtaagtggctgtgggacagggattggagggagatttttttttcctgcatgctcttttgtcccgtttgtactttgataatgtgctattaaattttttaatttaacataatttttcaaaataaaaggaaaatgatgtcatagattaatgaatccaattcacctgctttcttggccactttttaaaatagccaatacttgctgcttaaagggctccttccaatgttttaaattttaaatttaacataaatagaaatttaaaatttctttaacgtagctttgtatgtgtatattccttctgaaaataaagtgggaaacaaatctattatactgcaaataatattttgctctttacattactattatgtcacctgctcatattgattgtcctaatgaaattacagccccatgtatagaggggatatactttcttgtttgcttgaaagaactatgtttggagatcaagtttctgtcttacagaggaagcaaggcatggaagtattgttatctagtggacaagcagttttatgtttcaaaattgtttgccaaaattagcagctgtaaaacaagaacacagctgcaaatttcaaacttttcatattaatatataccatgctattttcctttgaaaccaaaaacatgtatttttcatttaacaatttcagcagtgtacacatcattgtgtttccctgaacaaatgactattatgctaaatggttgattttaaatagagtttccttattcaccaaagttgatacttttaacgttttgttttcaattggaaatttctgcttaaataattttcatttattttgatgtttgtaagtgaaaagttagtttgttggtaaaaaattgtcccgtattttcattgttccttcaaagtttatatttgctgaaataattcttctgaagttggagagattgtgtagcctgcacaaaaatgctgtgtaattgtttgatccattttaccatgcgaaaatttgtagccttgtgaaataatccaagaattttccttataccacatgttttataatcccaggttactagtgctaaacatggaccaaaacaaaattagtataaaactaaggtcatatcccattccatgaagaaattctgagttctctacactgttttcacctggcttacaggatatcatgctctctcagttttcttcttatctcagtggtcacttctctgtcttatttgctgattcttttccttccttctattttttttttttttttttttgagacagagtctcgctctgtcgccaggctggagtgcagtggcacgatctctgctcactgcaacctcggcctcctgggttcaagcgattctcctgcctcagcctccccagtagctgggattacaggcacacactaccacacccagctaatttttgtatttttagtagagacggggtttcaccatggtggccaggatggtctcgatttcctgacatcatgattcgcctgcctcagcctcccaaagtgctgggattacaggcctgactctctaaccttttaatttggtgtacaccagtgctcagcttttgtcttcaagtcttcaccatttatacccactcagtgacctcttatagtcctgaggcttaaaccatctaatacactaatgactctcaaatttatttctcagccaagacttctcttctgacatccattttcaattacttatttggtaatttcatttggatgtttaatagatatcttaaactcaacttgcccaaaactaaactcctgatctttccctcctacccaaaacttgcagacttcccatttcagttgacggaagctccatcctaccacttgctcaagtcaaaaaccttggagtcatcctgaaagctctcttccttgcaataccttacatccactgtattagcaaactctgttcactgtacctccagctccacagctaccacccttgtccaagccaccatcatctctcatctgggttaaatcatacagccttgtaacaggtctctatgcttctcagagtgatctttttaaaatattttcttattacaggttagcatccttttctttcagattggtatcatagaagtagaaagtggaatagtggttaccaaagaccaaacaggggaggaggaagggggaaaagggagaagatggtcagtgggtacaaagttacaattaaataggaaacataaattctggtgttctcttgcacagtagagggaccatagctggttaagaaaaatgtattgcatatttcaagataaatagaatagaggatcttgcaagatatcaccacaaaaaaaagataaagatttgagattatgaacatgccaactatcctgatttgatcattatataaaatatgcatgtattgaaacatcacactaccccataaacatgcaattataatgtgtcaattatttaaaaataataaaagagtagacaaaatatatgagtcgactctgctaaaaatattgcaaatggcttctcatttcactcagagtagaatatttacagtgatctaaaataccctccatgatctagctccttgttacctcacctccttctacattttttcttaactctgcagcattgttactgacatctttgtcaatctccaaaaaaaaaaaatacttgaggcacacttctgccttaggtacttcactgtggctgactcctctacttggaatcttcttcctccaagtattgcatgttttcactcttacacctccatcaagcttttgcttaaatgtctgcttctcagtgaggtctactttgacccattctacacactactgcagtttgcaccataatccctgaactcttaatacctttaccctgctctaccttgtctttatttccatagcatgtatgaacctctatataatttacttatatactatgcttattgtttattgtctgtttccatctacattaattgtaaattctgaggactaggatccttgtgtgttttgttcactgaagtccttaaaggccctagaatagtttctaggacttagcaggtgttcaacaagtacttttgaaagaatgaatatagaatgtaacttttggtatatgatttatgtctatgtctttacacagaactgaataactggttttgattgatatgaactattatttcttgcacaattagtatttttaatttttgtgggtacatagtaggtgtgtatatttagagggtacatgagattttttgatacaggcacgcaatgtgaaataagtccatcatggagaatggggtatccatcccctcaagcatttatcctttgagttacaaacactccaattacactcttaagctattttaacatgtagaattaagttattattgactatagtcaccctgttgtgctgtcgtatagtaggtctcatttgttctttctattttttgtatacattaaccacccccacctccccccacagccccctactacccttctcagcttctgataaccattcatctactctctgtgtctgcgagttcaattattttgatttttagatcctacaaacaagtgagaagttgcaatgcttgtctttctgtgactggcttatttcacttaacataatgatctccagttccatccatgttgtcgcaaatgactggatctcattcttttttatggctgaacagtactccatggtgtatattaccacattttatttattcattcaccagttgatagacgcttaggttgcttcaaaattttacctattgtaaacactgctgcaacaaacacaggcatgcagctatctcttctatataatgatttcctttattttgggtatactgctactatatactatacaatatatacccatcagtgggattgctggatcatatggtagctcaatttttaggtttttgaagaatctccaaactgttctccatagtggttgtgctattttacattctcacaaacagtgtgcaagtattcccttttctgcacattctcaccagcatttgttattgtctctcttttggataaaagccatttttgctagggtaaaatcatctttttttttttccttgaaacagggtctcgctctgtggcccaggctggagtgcagtggcatgatctcggctcactgcaacctccgcctcccaggttcaagcaattcttatgcctcagcttctagagtagttgggattacaggtgcacatcaccatgcctggctaatttttttttttttttttttttggtagagacggtatttcaccatgttggccaggctggtctcgagctcctgacgtcaagtgatccacctgcctcggcctcccaaagtgctgggattacaggcgtgagccaccacgcccagccgggtgagatcacatcttactatagttttaatttgcatttctctgatgattaatgatactgagccttttcatatgcctgcttgccatttgtatgtctgggtttgagaaatgtctattcaaatcttttgcccatgttttgataggattattaggttttttcttatagagttgtttgagcttcttatatattctggttattaatcctgtgggagattagtagtttgcagatattttctcctattctgtgggttgtctcttcactttgttgattgtatcttttaccgtacagaagctttttaacttgatgtgatcccattttcccatttttgctgtggttgcctgtgcttgtggagtattgcttaagaaattttttgcccagagtaatatcctggagagtttccccaatgttttcttgtagtagtttcgtaggctgaggtcttagatttaagtctttagttcattttgatttcatttttgtatatggcaagatataggggtctagtttcattcttctgcatatggatatccagttttcccagcaccatttattgacgtgcctgtcctttccccagtgtatgttactggcacccttgtcaaaaatgagtttactgtaggtgtgtggatttgtttctgggttctctattctgttccactgtctatctgtctgtttttatgccagtgccatgctgttttggttactatagctctgtagtataatttgaagtcaggtaatgttattcctccagttttgttctttttgcttagatagctttagctattctggctcttttatcgttccatataaattttaggattttttttctgtttctgtgaagaatgtcattgggattttaatagggattgcatcaaatctgtagattgctttggatagtatggtcattttaacaatattgtttcctccagtccatgaacatggaatatttttccattttttggtgtcctcttcaatttctttcatcagtgttttatagtttttcattatagagatctttcacttctttgattaattcctgggtattttattttctgtgtggctattgtaaatgggattactttgtgatttctatttaggaatgttcactgttggcatatagaagtgctactgattttttatgttgattttgtatcctgcaactttactgaatttgtttatcagttctgatagttttcttgtggagtctttatgtttttccaaataagattacatcatctgcaaacaatgataatttcacttcgtcctttccaatttaggtgtcctttatatcattctcttatatgattactctagctaggacttccaatactatgttgaataacagtggtaacagtggacatatttgtcacgttccaggtcttaaaggaaaggctttgagtttttccgcatttagtatgatgccagctgcaggtctgccaaatacgacttttataatgttgggatatctttcttctatccccagtgttctcagggtttttatcatgaagtggtgttgaattttatcaaatgctttttcagcatcaattgaaatgatcacatggtttttattcttcattctgtttgtatgatgtatcacattgattgatttgtgtatggtgagccatccttgcatctcagggataaatccctctggtcatgatgaatgatctttataatatactgttgaattcagtttgctattattttgttgaagatttttgcatcaatattcatcagaaatattggcctatagttttctttttttgatatgtctttatctggttttggtatcagggtaatattggacctatagaatgagtttggaggtattgtctcctcctgtattttttggaatagtttgagtaggattcatattagttcttctttaaatgtttggtagaattcagcagtgaaaccaccaggcttttcttttctgggagattttttattacagcatccattttgttattcattattggtctgtttaggttttggattttttcctagttcaatcttggtaggttatatgtatctaggaatttgtccatttcttctagatttttttgatttattagcatatagttgcagatattacactaatgatactttgattttctgcagcataagttgtaacgtgtcctttttcatttctgattttatttatttggatcgtctctctttttttctttgtctgtcaatcttgtttaacttaaaaaaacttttgtttcattaatcttttgtattgtttttcatttcagtttcattgaaattaaatgaaatgtatgctctgatctttattatttcttttcttctactgattttgggtttggcttgctcttgcttttctaattccttaaaatgcatggttagattgttaatttgaagtttctcctcttttttgatgtaggcattatagctataaacctccttcttagtactacttttgctgtgtcccataggttttggtatgttgtgtttccatcattatttgtttcaagaaatgttttaatttctttattaatttctccattgacccactggtcattcaggaacatattgtttaatttctatgtatttttatagtttccaaaattcctcttgttattaatttctagttttatcccattgtggtagagaagatgcttgatattatttcaactttttgaatgttttgaagacttgttttgtgaactaaaatatggcctatccttgagaatgatccatgtgctgaggaaaataatgtgtattctgcagctcttggatgaaatgttctgtaaatatctattacatccatgtggtctatagtgcagattaagtctgatgtttctttgttgattttctgtctggaagatctgtccaatgctgaaagtggggtgttgaagtctgcagctattattgtattggggcctatctctctctttagctccaacaatatctgttttatatatctgggtgctccagtgttggctgcatatatgtattcaaaattatgtcctcctgctgagttgacccctttatcattaaacagtgaccttcttttctcttcttatagtttttgtcttgaaatctattttgtctgatataagtatcgcaaatcctgctcttttttttggttttcattggcatgtaatatctttttccattcctttattttcagtctatgtgtgctttacaggtgaggtgtttttattgtaggcaacagatcaatatttttttcacccattcagccagtctgtgtcttttgattggagagtttagtccatttacattcagttattattgataagtaaggacttactcctgccattttgttatttgtcttttagttgttaagtggtcttctctttcttctttcctttctgtcttcttctagtgaagatgatattctctggtgatatgagttactatcttgcttttcattttttgtgtattcattgtatgtttttggtttgaggttactatgaggcttgcaaatactaccttataacccattattttaacctgataacaatcaacactatttgcataaacacacaagcaaaatgaaaaataataaaaactctacacattaatcttgttcctctgctttttaactttttgttgtttctatttatatcttattgtacttactatgtcttaaaaagttgttgtagttattctttttattggttcattatttagtctttctacttagaataagagtagtttacacaccacagttacagtgttacgatattttgtgtttttctgtatacttactattaccagtgagatttgtgccttcaggtcattattgctcattaatgtcctcttctttctgattgaagtactccctttagcatttcttgtagaacaggtctggtattgattaaatccctcaggttttgttagtctggggaagcctttgtttctccttcgtgcttgaaggatatttttactgaatatactattctatggtaaacttttttttcctttagcactttaaacatgtcatgccattctctcctgacctgtacaatttccactgaaaactctgctgccagacatattggagtttcattatatgttgtatgtttcttttctcttttctcttttaggatcctttttttcccttgacctttgagagttgtattattaataaatgccttgaaatagtcttctttgatttaaatctgcttggtgttctataatcttcttgtacttcattattgatatgtttctctaggtttgggaagttctctgttattattcctttgaataaactttctacccctttgtccttctctacctcctctttaaggccaataactcttagatttgcccctttaaggttattttctagatcctgtagtcatgctttattgttcttgtttttgttcttgttatttttgcctcctctgactatgtattttcaagaagactgtcttcaacctcaccagttctttctttgcttgatccgttctgctgttagattctgatacattcttcagtatttcagttgcatttttcagctccagaatttctgcttgactctattgaattattccaatctctttgttaaatttatctgatagatttctgaattccttctttttgttatcttgaatttctttgagtttcctcaacacagctattttggatcctctgtctgaaaggtcacagatctgtgtttctccaagattggtctctggtaccttatgtagttcatttggtgaggccgtgttttcctagatagtgttgatgctaatcaatattcttcgttgtctgggcattgaagagttaggtgtttattgtagtcttcactgtctgggtttatttgtagccaaccttcttgggaaggctttccagacatttaaaaagacttgtgtgttgtgatatatgctttagggggcattctaagcccagtaatactgtggttcttgcagactcgtagaggtaccactttgatggtcttggacaagatatgggagagttctctggattatcacgcagagattcttgttctgttcccttactttctctcaaagaaacagagtctatctctctgttctgaaccacataaagctgggaatggagtgacacaggcacctctgtggccaccaccactatgactgtgctgtttcagacctaatgccagcacaacactggttttacccaaggctggctttaaccattccctggctactgcctatgtttgctcaaggcctgggggctctacaattggctggtgtctaagccagccagctctgtgtccttcccttcaggtcagcaaggtccagaagtgttgtccaggagtcagggactagaggtaaaaaaaagcctttgaagaatacctggcgttctattgtattgtagctgagctggtactcagaacacgagagacagtccttcccactcttctttcccctttcaaaagacagaggaacctcgcctggtagttaccgccaccccaggccacagggagtactgccagactactgctgatgttcatttaaggcagagggtcttttaaatcagctttttgtgaatactgcctggcttggaactcaacctttagagcagtgggctcctctctggcccagggcaggtccagaaatgctgttcaatagtcaaatcctggaactggggaccccaagagcccgcttggtgttctagccccacttcaccatactggtatataaggtgcaagaaaatgtcccctttgcttttccctctgcttttctcaagcagaagttttgccccattgccaccacagctgatcatgtgctgagtctcacctgaaaccagcaagtctcagaggctcactcaaggcttttgatgggtatcattgctgtttatttggggtccaaaggctcttcaattagcaggtgatgactgttggcaggactgggtgctttccttgaaggcagcaggttcccttctggcccagggtttgtccagtaatgtcatctggaagctagggcctggaacaggggcctcatgactctgaccagagccctatcctgccttggctgagctggtatacaagatgcaagacaaaggcctcttcattattgcctctcctctcctcaagcagaaggaaggggtctcttttggagctgtgatctgtgcagcctggggttaggggagttttgctgccaacactcccttggctgccccagctggtgtctcaagtatgttacatgcccctcccagtccactgtctctaggcctacttcagcactaggactcaactaagagttgcagtccttatggcctagattgtcattcaggtttacttggaggcacagaatgctgtagccctcagtggtgaggtttgtacccactcaagtttggacctctgagatcagtgattccctccctggctagggctggtttaaatgctccctctatgggtggttgtctgctgagtttggtccggttatcctttttgctctaacaaacagttcagcactgagttcagtgtctcataattgctgtgttctccctcccccagcgcccagagatactctctacaccacacagctgctgccacgggcaatggggggaggggggtattggtaattcaggactgttttttctatctcttcagtgccgctttcagcaatatgaagttaaaaccaggtactatgagtgctcacctgatttttggttcttatggtgttttttctacatagatagctgttaagttggtgccttttgcggggcaatgggtggaactttctattctgcttcctccacatcctccccctatttcttgcacaattgatttttaaaggctttgtttatatgtgtaagccagtttggtttctgaaagacttggtcaatcagctcgatgaagtcagtagtttttaaactcttaatagttgaatcagtgaaacctattttctggtttcctggatttgttccgtttcagtttatgatgactatactggcccttatggtaatatattcaagctaacttgtgcatggagaaatagttgcaattgatatgccaaatcaatgcatgtagacacaaccacattcaatcacaattagtcaaatgagtgttgtagaagaactttatactcagcatagttcattttaagacaaggaaatagcaaataccaattgattgaatgtccataaataaataaataaataagcacatgcatgtattgttttgagtgatttatgaaaataagcaagttgatcaaaattgtcaaataggtcgattcatataagacattgcctaaattaatatgtcatctgactaaattccctagtaattccagtaaaaactattgaaattttagtttatgaagatataatcatattttatccaataatgcatcaattgattttttagaaagcattccaattagaatgatcaatcaatcccatcaaagtttttaataaatgtggatctatagggtagtcacacctaaagtaagactagaataagaaagaataaggtgttaaagtgagattttactaatcctgaatcatgtcggagtttgaggaaatatctgtagaggttgaaaagtgtggcaaatggaagttcagcacttcagccttaaaagaatcataaacccataaactcatgacatttttaccagtcctcccatatttatttgcagtcaaaacaatgccacagctgacatttaggtaccccaggaagcaaaaacaaaacataacagaacaaaacaaaaacaaccaaaaaacagaaagataaggaaggtagacagacaatgctagctccatggattaagtacttgatatatatttttactcgccctcaatacataaattattttaacctttagttgcttttgttttatttctggatgttataggatactgtttgctcatttgtataacttgcatagggagaagtaaggatttgggaagtaattttatcttgtgcctcagtgtagttttgtccctaagctctgtcatttgtatatcaaactaatactgtcatttttatcagcttcagccacaagaaggtttatcaagatgtttctgttttacttctcgtttctaagcagctgcctagaactagagtcacgagtctgctaaattgggcaggcattcagaatttttttttatcacgttctcccaagaatcataattttataaaaagaaattagcccaaggtaaatctcaggagaaaagtggttttctctaataacttgcctccaacgaagcggttggtctttacccacaagaactagaaataataatttttttgtactttataccttgggtctgggagatttaaagaaatatcttgctttccaacaacttgggtttcagttgttccagattgaattagtgtaaataacataggaagaaggaccctagcaaatcaatactgcattggtagtaaactggaaaatactgacaaattatccttttagtccttagcgaggtttaatctaaacatcgttttctcctgacagcatgagagagaagagagtaatttattacaccatcctgatatggatgagaaaagactgctgcatgttcttcagtgttctggctctctccttctttatgccagttcaatttttgttttgctccagaaaagcactctccaataatatggttacaggtcttgtaactttaatgccgtagcactactctcttccattgtacatttgagaacttgccagctggtataagaatgtgggttaagtgctcagttgagattcagctgtctctcattacatacatggggtatgttcctaaagtcctgtacgcaaataattttatagctttacctaatgtgtgaggtcactatgtagaggagtcttttagaaaatcttgtcacattataatgtgaataattaccctgcccctaaatttcacgattttcataactcgagatttttgcttgttgggtttatttaaggtggactctctctcttattcagttaaagcttacttcatttataggaaagggggaatttgtgtttactgaaggaaaaatatttagcattatttctttcctaatttcctgtggtttttgtttcatcaaacaactcttattccatgtgataggtgtgtaatacaaatatgtgaaatatgactcacaaatattaggtcagcaatttgttcatctttttctgttaaataaattggtcatgttaaatgtcacattttccaacttggatatgataaaatagcacttttaattaacccaagagggatatggacataagaaaaccataaacacttgctccaggcaggatcctttctcaaggaactgcattatgaatatgacttaaattactggttatatgtatcccgtgtattttgcaaaacctaaaatgttattatattgtcattacacttccacagttatcatcaggataataaagaaataaactcaaactttctttttgttttttttttttttttgagacagggtctcaccctgtcacccaggctggagtgcagtggcactatcttggctcaccgcaacctctgccacccaggttcaagtgattctcctacctcagcctcctgagtagctgggattacaggcgcctgccaccgtgcctggctaatttttgtagtttttagtagagatggggtttcaccatcttggccaggctggtcttgaactcctgacctcatgatccacctgcctcggcctcccaaagtgctgggattacaggcttgagccaccgcgcctggccaacctcaaacatttttaacacattttgagaatagtgtacatactaaatagcaataaatgtttccctacatactcttccccatatcaaatccaagccttaaaatgtttaattgctcatctagactccaaaaatatttaaattaccaggtacctctagccaaaggataaaaacattaaattggaaatgattaacatatttacaaaaaagaggaatttttctaagaaattcggttaaacttagttccactgactcagaagaggaaggaatttcttctggaaaacattttctaaaatagcaaaattcatcataaatatatgattgggactattaaatataaatgttgcagtcttaatcatctatagaacaagccattatgacaagatttccctgtataaatgtgcagcatgtttcatatgccagtgtgttaaaaaaaaaaagaatcatttgatgacttaaaaataactaactgaaatatttgaatttgctttgcttcagatatcgtatgaaatatcattaccattttgtgagaccttttaggttattaaacatttaaaaattccttctgtgaacaaggcacttttataggagagagacagtgggaagataaggggaatgtaaggattacagatgtgctcacagcttagcagcttgcttacttggacttaatgatactgataagagtaattctgatgacattattaacctatctctatataactcagccaattgaccagaataagatcaatattttttcccagttgtcaagacagccaatcaccatggctttgattggatcatggcatggtcaatccaattcattaggtaagattactgaaataaaccacactgagagaaaccaaatgccagttaggtagtgagcaagtgccaagtggtggaagagttctataagagcaagctcatcagatgatttcttcaagtcgttattcatgtccagaattgattcagtgagtaaagtcatttgaagggtctggaagatataaagtcgaaaaaaatgctttctaaaatttaaagtgaaaacatctgttagcatgtattagaatttgtttcaaaactacaattttttattgtacaaacatttgtcaaaggactaagaatccagaaataaataattagacattttccttgaccttgagaagttcataatcagtgggcagagtaagggagtagacatataaatagataattatagtgcaatgtagtaagccttgtaataggtgtatgtaaaatgcatgcattagaagcacaaagaaaataagctggagaaatctaggaggatttcacagagaatgtaatatttgaattttatcttgaagtatggatatgaatattttgtctttttctttattttcttctatatttgtgcatgtgtatacacacatgcacatgcattagtatgtatatcagttactaccctttcatttgtgagtgactaggaaaaggtaaatatttgattgcttctggttttgggttttttttttaacagctttattgagatagatttcacacatcatacaattcactcatttaaaatgtaaaattaaatggtttttattatatttacagagtggtgcaactatcaccacaatcaattttagaacatcttcatcacctcacaaaaaccctttacactcagctgtcatcttcctactcctttatcccccaactgtaagtagcactaatctacattttgtctctacagattttcctattctggagatgtcatacaaattaaatcatataatatttgtcaatttgtgtctggcttttatcgctttgcatgttttcaaaatttgtctatgtcataacacatcagttaaattccttttaattgccagataatggctcattgcgtggagatatcacatttgtttgttcattcaccagttgatggacatttggattgtttccacttttgcccttctgatttcacagagagtgttctatttgttttcttttaattttctaatgttccatcttgtcaatttttttatcatcttggataaaaattatttttccccgctgataattatatgttctactgagaatatgataaatgtggttttccctcagatgaaaataatctgatcatatctgtggtcctaagaaaaatttttctctactatctgtgagatgtagaggcagctcataagacagtgacttccgaccttttatggccagggctcataagaaatacatttttcatcacaacccagtacatacataatttatgtgtatgtattaaacaaaagtttcacaaaacagtgtttatgcttactatatgcagtgcactgtgatagcctatcctattctagtctatcctaaccttttctgttctattctaccctatccaatctaccctgtcatattatagtctattgttttaaatgtacattacatgacccatacattgatttcacaacccactaccacgtcactatctgaaattttgtaaacttcagatttcaaatctgaagttctgttataggagagagaccagaacacattctgtgtccagaaatattcatctcatctttctgaggcaatgactaaagaatggtattttattttattggttgatacccatcaaatgttggtgaataataaaaagcccctatgttgacacctccattcttaacctactgacctttagaagcaaaagaataattactggtatagttcattaccttcagaacagtaagagtaactgtgctatgaatattattcccttctcttgggaattaactttcctattatgactcataacatttcttttgtactaggaatgtaaaatgtaccacttaaatataaggcattataaggaatttagggcattttaatataatgtttaagttttttgatctaatgttttcatctaatagtttaaggtcttttaatctaatgtatataacttaaatggacctttccctctgtattttaaaggatgccttaaggtgacatgatttctctagaatgacaagtcccaaggaagtataagcaaaatattcccatggagagtgatagaataacatgaaagacagttcagactcatttctcatatgactcacttctctaaatttggctttaacagcttatattctagaaggaaggaaaattggcagtcggaattgaaatgccagtgaataaaatgtgtctataggacacaatatgataatattacatgtgttggtgacctattaaaaaaaaacaaactgaaactcccaccaccgtacccaacactccttcataactcctaaatagaagggtactcttattctcttcctatggtgacttcattgctgactttcttcctttttctcttcccacacttctccacaaacacatacaagttgggaaaactcctccaaagtatcttcctaccttctatacacaaatcttcctttcctcttttctttatttttccacttccacaatcttcctgtctcttttgtacttgtggctgtcatttccagaagaatccaagatgtacaattgacaggaaacaccaaactgaattatagagacgggcagaaacttcaactttgcttctttcctctttacctgttaccctgcactttcagagaacttaattgtagattgcaaaatgaagatcaagcaataaccacacacaatgaaggattcaaggaaccctaaaaaggaagaaagtgaaagtagtagaacctttcttgttacacatctctattttatttattcaaatgctattcttttttaagtctatgtttccagcctggttaatcataaaagctcaatcaagcacttcattttggtcttttttgtgtgggattattaatgccgtgggtggagaatttcacacaaagtagtacacttaagtcatgcccaataatggctcagaaaattggttttgtgtatatactttgtaaatagataattcccaaatcaggtaagaaaagagaaaagacagaaaaattataaataaaagtgtagaatatacttctatagtgaaggcttatccttatttcaattaagaattatgacttatgaaagtaaatacataaaagcttagatccctgttgtcaaatgcgaaacatatgaaagtatcacagacctatgaaatgccaaatacacttgcacttattcacgggcactaataactttaattaagccagaacatctcaaaataacaataatgaaaattatataggtaataagactataaactggacttgaataaatgattttgttttctttagaggatgttggctaccattcagtctccaagtataaaatatttattacatgtccatttgcgaaaaagataatttttaatccaattcaattttacatttttctattatcctaccaggcagagtttaatgcagtacagttgaactcatgtttattgaataagtttttcctacttgcctggagtaagtgcatttttctattttgaaaatctttacttaaacttaaatgttttccactatttttccaaacaacagtttagagtattgtgtttacttgaagttatgtcttaagattttgaaatttctttcccagatagtatttatgaaatatattttctgttgtcctgttgcagtaaactttttataattggtattttaatgtttcttaagccaaaagaatgatactatatgtgctagacttatactcatccttatttttggtttggactgataaatctacttttctgttaggaaaaatatctgtctgaaataatctgcctccattttctttctttttaatttcagtagttttgagggaacacgtggtgtttggttacatggataagttcttcagcggtgatttctgagattttggtgcacctgtcacctgagcagtgtaccctgtacccaatgtcttttatccttcacccacctcctaccctttcccctgagtccccaaagtccattatatcattcttatgcctttcaatcctcatagcttagctcccacctataagtgagaacatactatatttggttttccattcctgagttacttcacttagaataatggtctccaactccatccaagttgttgcaaataccattatttctttccattttatctgcctctattttctgacaggcagctcatctgaaaccctaacttcatagtttcttgacctctctctggccaataatcattgccttcactccatttccacaattcatttcctcttctccccctccttcactctcactgaatcacttctggtctcatcaaggccctcatacctccctagctacctatctatttcgtaaaccttttcaggctctctctcttaccctatttcaaccgtgaactcattgacactcttgtagttgcaccatcttgccaatcctcaaccattaatcagctttccttgatgttttctttcatttttccttcttcttctttctttcattatactgcttctgccaaagaaaatcacatacctgattgactggtgccagtgcaaattcataatatccaacttcagccaagcccttaaaactgcccagctgtctcgatttttgttcttaagtcagttcccattctagttccccattcttactgcactaatgatattgtctctgaaatatttactccacgcacaccttcgcagacagcagaaaatgttgctttctacctcatagaaaaataaaggccatcaatcatgaagtcccctctattccctgccaccctacactaaatatacctctatttatacttagtcttaccacatgtttcacagtaagaaatgtcctttccccttttcattgtcaactctcattctgtgtttttgatcccatacactccccacctcctctggagcttacactttcaatgccttctcgcttgcattattaatctctctattccctcataaatacttcctcatttaccatttagtcctcagttttcatgggttgctactaatttttttccggccctttgcccaaatatgacgtactctgtgaggccttccatgatcacattatttaaaatcacagcttcagatactgtatccacacaattacttccttttctcttttcttgctttaactttctctttagcccttgtcaatatctaacatgctttgacttatttttcttattaattatctgccttctccaatagaatataaactccatagggcaaggattttgcctgaattcttatcaactaaaacgaagtttgacacatagcaggaacaaaatgagtatttgttgaataaattaaatgtaatttgacttctatttccaccaggctattacagtcctaaagatcatcgttgagattatggctaaatccagtcctcattttaggtctcatcctacttttagtagaagtttgtgtaattgtacaattgttcccttaagaaaaatgatttatctgggctatccagtctttttagactccttcactgatgttttctcttcattccacccttgaaaggtatcagtgttcaccagatatctgtcctcggaccttttcttccttgcactctttttctgagaagtatcatccgtatctatgttttttaaacactgccagtggcttcccagtctagatttctagtccctacttttttccagaacgtttctaactgcatattggatatctactagatggcttgtatgtttttcaaactcaacacaaccagcattaattcagtaccctctcttcttcctgaatgccttgttttagttaatggcatcaacatctactcagtctctcaagatatatacatttttttatttattctaggcttcttcttctcccctgcctccaattctgttccaaattctaataactctacttcctaattccatttctaacatattcctttttctccatcttcttcacctctgccttacctccagccctcataatttttcacatgtgatataataatagttacctgattttttttctaccttcagtcctgcccaaatccaatcaagcttttatactgtcaccataaataccttagccaatgcaaatctttccatacttgtcccctcttgaaactcaacgactatcctttgtactctcagataaactttttactccataaagcctagcttcaacctacctttccaacatcttaaaactctacaggtaactttattcatttttctccaactacaccacacactttctcaactccagaccgacagcttcttttacccagaatgtcaatttctttcctttgtatctggcaaacttctaagcactattcaatagccagttcagatagcagctcctctgtagatctctaaatctcacaaggtaagtcaccttggttttttaccttagagcattctgtatcgtttatctctatgaaaaaaacatatttacattgtgtttcaaaaactttgttggcatgtttatcttttcactgaactgtgagctcccagccctcaagtaattaagatagtctagctaaggagatagcacacttacttaaaagagtaaatagtgcaaggtatgatatgatgatcatatgatagaaatggactgtgaatggagaaatggaagcaatcaggattacttcatggggttggatcatcagggaaggctgcacagaggaagcagctctcaaggttaaatggtttttggataagtcaagaagcaaggacccagtatttcacttgaggattatgctctgagccaatatgaaaagatagctcaagtagaatagtgagatggacattgggacagggagatttgagcttgattgtggatttcctaaatgtcataagtttgctattgtgttgtgtatttatatgcatatgcacatacatgccccttagatacttttcttttctacccattcttatcctaaaattaccaagtctaaactgaaagttttctaattcctcaagaataatctgatttatactcttgtattatcctatatcattcaaaggacttctcctggagccctgtaaataaggactgagataagggatgtaaatgcatagggcagtgcccaacatacagagagtgatttataaaggtcaagattttcctcttgacctcagtctctgatctcaggggccaaattagatattgtactgattcagacaggaaaacagaaaagaagagagaaagtcatagatgggataaaactttgatcacagagatcgttttgttgatgtgtcaacaatttttggctgataaagtgaagaggcaataaaaacagcagtgcatatgattctgcagtttgaacagcaaattgcagcaaattgtagctatagcattggaagttcttcttgctctctggctgtctctttattcagaagtttaagttaattaaacttggctctcatagtgtttgaatgccaattctaaatgcctgtggttagaaaaatcacactctataaaatcggtcaaaatgcatattctagaagagtcatcacaattgatagtgatatttcctaacatccattcatcctagtattcttgtttttttttcttctattgtgttttttctaattattatccgctgagattagtggtttgccctttgctttctggcatggcacattgtacaaatgctttgtggtaggactttaatttgttcatcatgacaccgtttctgcctttgcccatgggaaaaataaaatcgagtcattcctcctctggccttcttcagcacatatcctgtcagtatgatgtttatctcaacctgcctattgatgattacattgatagtgccatatcctagtgtgcggctctgtgctcctggctttttagttttgtagagtttacttccttaatagaaagcctgtatgaacttaaaaagtcaccaatcttctcatattaaggaacagaactacctataacatgggtttccagccactaccttattcaggtataaatcaaaaaggaaattatgtgaatggcagaatatataaagctgtgtgataatgagccacattgtagtgaggctctagcataataactctgaactgggtttttattttaagtcactgaaaatgagggctggaaaatgtaacagatttgggggaaaagaggtagaattagatctactatatttttgaagtattttctgaaagggaagtgggatttaaaatattggattgtttctttttcagtcttttttatcccattaaacacaggctttgggtataaatcctggtatagctgactaccagccttgccaccttgggcaaattttgtaccctcttaaagccacaatatcctaatctatggccacttcacaggagtagtgtgaggataagttgtgtgagtaagaactgtaaatgtataggatgatgcctaacatatagaaagtgatttatagagttcaggtgtctgcatttggtggtagtttagtatcagaaagtagtaaacaaaatagctgattgagtgctttctcttatcttccactggttagtatgacatcagacagaatattagaacaaggtacttgtattagtttttcactgccgtgtaaaaaattatcacaaacttaaggacttaaaacagcaatttattatctcacagttgctatgaatcagaagtctggacacatctactgggtcctctgctcagggtctcactggactgaaatcatgatgccagctgggactgaggtctcatctgatgatgctcttcttggcagaattcagttcccttgattataggactgaagtttctattttcttgttggctgtcagccaggggtcactctcaactactagagactgttctccagtttttgtcacgtggccctttccataggtctactcacagcatggcagctttgtctaagccagcaacagagagagagagagagagaaaaaaagaaagagagaggcagaattttactacatactagtaaaatgagtcctatatgtatatggtaatataattgtgagagtgatatcccaccacctttgctgtattctattgattataatgaagttacaggttgtactcaaactaaaagggaggggattataaaatggcataaatatggtggccatcttagggtctttgtgccacaatactcaaagaaataatagacaattcactggcctaagtcttaagagaaataatgggtagtatcccttgataatagtttaacatgcctaattcaacatgcaaatacctcatgtttctttttcctgaatctatgactcttgaaactaatattttggagattattgaaggataattttactttaaaaatattaattacgtaagtaacacatgattatattctttttgtaaaacaagaaaaattaaaccatacaacaatataaaatgaaaaagtaatttattctgcacctcctccttacctttaccccttcccctatccagaggtgctcaaggatgatagtttgatacttattcttctgtaatatttttaaaacataaatgagatcatgttatatgtgcgttctgtaacttgctttattcttttttaaacaatgtttcttgaatatctatgacagtatagatagatctgcctctgttgcttgatttttttttactatgtgtgagcaattaggagatttcccattttttacttttatgagcaacactacaatgaattctatgtatgtacatatttatgtacctgtgggaattatcctgcagtaatagattccctagaaatggaattgatgggtcaaagggtatacacatttaatttttgacaggaaaacaatggaagctatctgatatttaaatactggtaaaatgtcctccaaaaagaccagatacatttacaatcctagcaacagtgtttattcaagagtctcatttttgtccacattaaggtcttttccaaaatcagcaatgtgttactcttaggaacgtgataggaggtgcaatagaggtcgttgcagatggggatgagtaggagtgaaagatccctggaaactattgacaggggcagtatccatttggctgaccacagaaaatttagatacactaaaaaatttggaaactacttccaaggctgtatgatatcaagagatgtataaattagagtagtcattcagatttagcccacattatgcacacatacctgcatgtgtggggagggaggaagaaagagagaatgagaatagctcatttagagagtgaacattttagaagtataaaaatatagcagggaatgttgataatgcgtgttattaactcaacagctctaagagtccttcttcaaagccatttccaaagcacctgtgattacatgattagagaccccttaaaacaagtaaaataggtctgtaaactaggttatctatcagattactaaaaagcccgctgatagctgtcataaaataagtcaccattcatacccctgccaaagaaatacaattgtcttgataatatataataatgccaaaggatattttgtagaatgccactgctggagctgcatggagattcttcaatttgctgattacaaagcctactcagaatcttaaggctcaatcctaaccattgtgatttgtggagacttgcatttcttgtccagtcttctgaaagtaattacaaatgctgcagaaatactcagttttatccaatttctgacagatatattctgagtactcccatttatttattctcttttgaatgagaatacatgagaggaagacaacaagaagatagaccttactccatgctttctgttttgcacacacacacacacattcaattaattatgtctacaatttatggatcgatcatgtaaagtggtaatcttggcttagaccaattggtttaatcaccctgaattgcatgtccaatacagaagttacagacacactacactgccactgctgaaagttgctgattatagaacatcagtagtgttttgaaagattcgaaggtattttgtacacaagcaatttttaaagggaatgattaaacaagatttatattatttcttacgtttagaagtaaattattatttcaaatatgttataatttcccaaaatatgttatagtgaagccctagttttgtactagactccaaagcaaaatagcccatatattcaggaagtgctgattaccacagcccactcttggtgactgagagtacatactagcatatttaaaggctctgagaagtcctttaataaagaaacctgtacagatatgttcaacacaaagttctccaaatttatttgtattgagaactcttttctcttaaaactctcactgacatttccacacataaagaaatgtaaatttaagagatatcattcctagcattagcattacttagctgtaaaatacttatttcagtgtttaccgtgctaatgttatatcgttccttttaattaatttgatgaaaattttaattcctcttaaaaatacacatgtatctcaaaaatattgaaagaatacacttggctggcaaactgatggcagctttatttataaaactcatcattaaaaacttattaagattgtggaattagtcatgcagtggggaagaagataattctggataaccagatctcttttttcaaaagattatttgaatcatgtttaatgaaaaaaaatgcagccctcagaagatggcatttgataaagcttcatctttgaattaatttatttttcctgttatcattgttaattttgcttgtgaaagataatctaaggacatctcaggaattagataaagaaggactgctgggtcaccttcatccaggtgatgaactgataactgtgattgaaaattgtagtcaacttaaaacaaaacaaaataaaaaaggaaattactgtcaaatggaagtgtagttttggaagctgaacccttataaattgtattgatggggaacctgcacctgagccacggtgaatcacttcacttggattatatttaatggcaattggaaatatccttgttccttatccttttattatatggcagtttttttgcggttcagctcagaaagtcaagtttattgggaaataaattttcagtgtttcatatgttgtctttaaagaaacagtggtcaccacctgctgcttgacacccaccgatgtcgtttttcttcccaatcaaagaaaagcaggtcagcaatttcctagcaggacaaaagtactaaaggttacttttttccctgcgttgtatcatgggcaaggcttatacctagcatgatgtggggcatatctcttcctaacctccttccaactaccccactccccctaagaagaaatatttgtactactgccacgaagcctgaaattccatagtagcctcccctctggatctgaataaattaaatatattctctatgaaggctacaatttggccaggtgcatattcacgcaaagcttttattacttctaagcctttgtataacctgttcctggtgcctggaacattgtactctcctctcttctccctgacccccaccctatccactcacccataaccctcccagcctgccagacttttctctaggatatctaccctacccgcttccgtacatgccccatcacaccctgtaatttccctaccttatcttaaaaagtgggagggaggtaagtcctggtgtattttccttgctttgctctaaggtcctatatatattttgtaatccttaatcactcagggcattcaaggcaatgtacgtctctctaggttacttgtgttagagaaagacaaaaccaagggacttatctgatgctcggaatacaggaccttaatgcagctttttgtttgcagaaaataatgttactacacattacatattgcagagtttctgcaaatttacacaacctaaaagcccaaagagtccccttacatgctacatgatcttgttactcaaaggatggtccacagactagcagcatctgtatcatctgagaccttgttagaaatacaaaatctagggcccactgaagacttactgaatcaaagtcgggattttaacaagagtcccaggtgatttgtgtgcacattaaaatttgagaagcagcagtctagaaaaaatgctggcactgtgctggatatgtgtcttagttaaaagtgtgaaagactgaaagggaattaccttttatttatttggcatagcattacttttttagaacctcaagtccaaaattaatctaagtgttttgaaaattagagaatatgtaatttttaaattttagaataattaaatgtgtttcttttgtttttaccccatctcctccaaggatgcagtgattctccagtaataatggccctactagtcacctggggtgcttcttatacatacaaatctctaggccacagccccagaaattgtatattacatggcctgtgataggtctatgaatctgtagttttaacaagcttcacaagtgattctgatgtaggtggtccatggacctcattttgagaaacagtagggggtcaggagtgacagggagacagaatgaaatgtaaatatattaaaataaataccatctgcatcaacttaactgaaggtacgtccctaaaaatacaacaccagttgacagtctttttcagggaaccaggtgaatagcatattttaccttcagtgcaacttttattcatgtttgccgagtttccacaatcagtgacatattatttctcaacatgaaatattagttctgtggaagggcctgtggttaaaagccttacctatcattagctatcaatgtacataatcttctactggaagcactcaaaacatagcacaaaaatatgatcaccccttcccctccaccatgattaccacccccgtcaaccacacagtccatcaagaccaagagactactgctgggagcaccaaaggcagtgttacggaaggggaacttcctcttagggatcaaatgtagctctctagactgtagcccatgcatttataagaacttgagaatgacttgggtctattatgtgtctatttgcctggcaatagattctggaattgattaattaaatacattggaaatgataaactggaatacaaggtaacaatagtttgtgtgctataaataggaaaacacttatttttatgcccttgaaaattgctttctacttggctaaaaaagatctagtgccatcaactctagagaaagcactaaaggagtggctttgcctgtatctaactaacgattccacacagcactgaagtagaaaaagatgagtctcttacataaagtgtgcatctagagaggagggtgagaggagccactcatgcataatgtggctcccctgtgaacaaaacaaggaagccgagaagtagatgaagttcttgatttcaccctggctgttaatgataatgaatcattgaatgcatctgttccttgcattcctacggcatagaaggaggaaaggaacataaaatataaaacctcaacgcagttaaactacacaaaatgaagaaaacactaaagaaagtaggcccctcagttaatggaactacaagcaccaaatgatactctttaagaggtagtgaagcccagctgaaatctgcatcaggaattctgtggggttatgaagaagaacacaaacaagtttggacccctcctttaaaacaacagcaattttcctgggaaagaaaaggtgctaaaactctgcatttcctcccaatggactgttgcagtattttatgaaatacgtgaagaataaatgtattaattctactcataaatgaacaactccatgcattgttcaaactggctaaagaaccactaaggaggattcctgaggtgaggaacagatctcttaaatgagtgatctggtgaaaggagtagggagggggggaggcaacgggaatcagctgtagttaatatacttctaggctctgaatagagtggcaagcagcacattctgtaaactctcaagtactgaagctattgcaaatagcagtaacaacaagtggctctagatgagcagaatgcttggcaaagctgctcaggaggttaatgaagttgacatgggtttgaaaaagtggaaaataatgcatcttgaatgacaggatctcattttgaaagaaacagtgcttaaagagaacaagtttaattttttattacaggtgcactgttgattatctaattcaaacatgggtgatgtgccaataaaaatacccagtacatgatcgctttttacagcttgcattcaagctcggacaaggcaaaaatgatactctgaatgacagcagaaagtacatttaaggcgttcatcactgcgggtttgttcatgcttgatgaaaggacctgagatttgagagaagaggtaggatgatgtaggaaatcgcatcatttgatctaagggaccatgaatggaatgactaacggtataatgtcaaggacttctgtacagttcaatgcagaggaatatagtccccttgtactctgacctttgggctagaaatccttggtaattagcttaaaaatgaaaccagtatgctatggactaaattatgtccctcccaaaactcatatgttgaagtcctaacccttcatgtgatggtatttggagatggggtgtttgggaagtcattaggtttagatgaggtcatgatggtatggccctcatgatggaattcgtatccctataaaaagggacaccagagagcttgctccctccctctccaccctgtgaatacgcagtaaaaaggtggctatctgcatgccagaagagaccccacacaaaaaacttgatcatgttggtaccctgatgtcagacttccagcctcaaaaacggtgagaaagtaaatgtctgttatttaagccacccagtctgtggtgttttcttgtggcatcctaagctaaggcccagtggaattgtcattcaacttccagcttggtttccttttcataaatagagcatcagcaaaggaacctgctgcttgtgagtaaaggtgggtgacatgcgcatattgactttgattgtttcaagcacaggaattcatctgatttctcctgtcatttagcagagccctgaggaattctgtcagtcttcaggggtttttcatttgttcatttactcatttcagaaatatttattgagcatatactttgtatcagaaggtacactaggtattgggccatggtaatatggagttctaggcagtagactgagagcacagaaatcccaaggggtgatgaggaagaaataccagaagagacatagaaaactaagggaaaatgaagggaaagacttgtcatgattttgcctatacccagtcctggtaacactataagtatgagattaaatgctgcaaactttggaatatttctagggaatcaattcgactttctagaggccaaccattcaattacaaacataacttgctattgaaaaaccacaaaaaaagccaacctacggtgattatgcatgagagacaaagttactcaacatgttcttaatgtgtcctgtagtcttcgtttagagatcttccagaattcgtataatccccaggaggggcctctatttctgttaagatgatgctggcatcacatgccttcctgtttagtaagtggacagtggtttgagagcatctgaggtgataaagacatagtgaacattgaccacaggtaaaaggaccagtaggtggtatgctgattccatgtctatcaaattatctccaagtccattccttttttttttttttttttaatcattcacagaaagaggcagccacaacactcacctgctagccaagatgggtcacaaactaagctgtgcatgcagagcttttgagaaaccccaggttaccaggaatagtacagaagcaattgtgcatgattggtactcctctgcgccttgttttgtccactttttcctaataacagggaacacatgttgcatgccgaggaaatctttttgcctttgcaggagtccttgctttcatttacagaatccaagctccctaagtattgtagctgggtttaggtttagtttaaattctattgctgatccatttgctccctgttttgcctttctttaaccaaaaggacaaaagatgatgtgtttatctaagtgtgtgtgttttccactgaaggagaaaggcatgggggagaaaacactttttccacccaactgaaggtaatgtttagagagtactgttttctgactatttttgttgcctgttgttttagtaaaaagtatcgagttacatgacaaggttttactcttctgagccctcaagtacaaactttctgaaggtaattttaggcatagaaatatcttttccatggcaactatgtgcctattttgatcaacagaaaagtgtaaatcaccttgaaataagcacagcaaatcatgttctaacttcattcctgttctgctagagaaattgaactgaaatgtaaaagtaaaatggcatattaactttgctgtaacatattaatgtctaagtaaaattataatgtatattataaaatgatatatttatatatgtgggtatttttaagcttttctttggcaaactttcattagtaatgagcacctagagcttcacctaaggtggccaactaggcagttgagtactgattagcacatattttaagcaggatctgattaacctaacgaaaacagatcagcagctttttggaacataaggcatttcagagatgttgtgctatgtacatttgcagattcatgtagcttctaaactatgcataagcagcctcctctctttatttttttgtgcatttatctgtaaatgtgctctcaaggggttagtcttgagctgtttctaaaattaaccatctaacacaatatgtacccataatttgtactcagatacctgagcagtcattctcaaagtgaaataaatgattgaatttttcccaatgtttctgccatgtttattactaagtctcattgcaaattgaatagctaatgctccaagctaggtgatgatcaatcttaaaatataatcaatactttaaaattatattatgctttcagaattttcattatgaagcagatcagtcttgagcctctcccaagagactttagttgatgggtgtatcaaaagaacttatataagtggtttttgcccataagagaatctcatgttataagttccaatgacatcattattataagcttattgtgtagcaccttgaatttatctaatggtgggcatctaagaaaagaagtatattttaaaagtagtgttaggttaatcagatcctgcttaaaatacgtgcaaataatatttggtggtcaatattattatcgtcatttgaaagacgaaagaacagaggtccagagaagtcaagccacatgtccaacttataagaagtcattgccggaggttgaattctcaaggatccaatcctgtgccctatccactcctgtcactcagctgtgaagccatcaaggatttactataagcaaaactaaaagcagcaggatctccttcatttgtgatgtaccaaagagataaggtccaatcacttaacaaaatgaactgaagctgattgcatctgaaggacagggaccagacgatttaaaataacttttttttggttcatgcctaaatgaccattgatgtacttcacttagaaaaaaatactgtaaagataatgcttcgttaatttccctcatcttaatatagtaacttttatgactagctaataaacattttcatcagaagaacagagctaatgatgacacttctgtttaatcagggacttttcatcacccttttgtacactgagtattccattttctttccctagtcttttctaaacacacacacgcacacatacactttttctgtatgaaacattttaaacatacaagaacagtgcagaaaatatggcatttatgtgcacacaaccaatattaaactcatattaacatttggccacatttgcttcatagcactctttcttttcaaaggtagaaaatttaaaagacctaggtaaaacttcacttccttctttccttcccagagttaactgctctcctaaagtcgatatagtttgtatcattccttgcatgtatagtataatgttactatatatgtaagtacccataactataaattactaaaactctttttactcctaaaatttgcataaatattttacatgttttacaaatagattttttcaaacagctttgtttttgagatttttttcaggtcgataaaggcagatctagataatttgttcctgtgtaatattccattgtatgaataaaccgcagattatctatttcctctgctgagagacattcaaattatcttttttttaaccacacaaacagggcttcaatgaacttccttatgcctatttcctgataaacacaaatgggagtttctttgggatagatacctggaagtggaattcggtttttatcttcaaatacattagatattccagatggccttccaaagtaattgtattcatttccgtatatccatatatatgtgtgtgtatatatgcatatacatatatgtatatgtgtgtatatatgtgtgtttatgtgtatgtgtatatatagagagagagggagagacagagagagaacacttttttcccatatcatcaccaacacgtcacttggtgttaacagagttattattttctttcagtctaatgggtgtggtggttttaatttgtactgccttgcgtaacaggtgggattgagtatcttttcagtattggacattggagtctcttcctcttttaattgcatcactttgtccttttcttgattttctttggagcagtttttatttttctaatcgactcataggaattctttatatattacagatattgatccttagttatatacattgaaaatatcttgtctcagtctgtgtcttgccttttcactttatcttttctaatctatttcaatatttttattttatttcagttttcaaaataaaaacaaattatggaaaactgagttttatgccttattaataggcaaagtcagatagtttctgtaaatataattgttgtgctcttcctttcttccatataacttccacacttgttaaaactcaagcccaaattctaaaaatatcactgcatttctatgattacagggcaagataagatttatttgggatcatactgatgtgggacacatttcttttcctcttagtcttctttctgcttcagcagaaaagctaattgcttatgcgtttcccaagcccatctgcccagttgagggaagaatctctgtctagctagaggactgctcttctcacaagtctgagagctggtatgcctgggggacatgtctgaaacctctctgctcatgttttatcctgtttgatttcattttctttaagtgcgagcaatgtattttctgtttgtgaataagattagggaggatgcttttccaatacatgttcataaaatgaaaaatgtttggcaatgcagttttggttttttacacctaactaggcagcaggtaacatctatctctgcaatattgcaaaactctttctacctgttttttttttctgtctaacctagaattaaaatagtgctgcatttaaaatattttttcattgtcaatatctttgtgagtttcagtaattccttttcgtcatcccataggcccagtggacattttagatgtggaggaggccatgtcacattcactcagatgtcaatgtttaaggttcctggatggatggtaatatgaaatgtttagaggcagtgtttatatggtttgaacataaaccattttacacttcactgattttcaccaaacagagaacatttctgcctttgtttcctatgctgatgaagccatattcacctctttagacataattgccttaaagtgaaagaagtcattttttaaactctgttttctagaagtctgtgtcactgaactaactgattagggaatgatagagaaaaaaaggctgggcgtcgtagctcacacctgtaatcccaacactttgggaggccgagtcgggtggatcacctgaagttaggagtttgagaccagcctgaccaacttggtgaaaccctgtctctactaaaaatacagaaattagccgggcatggtggtgcatgcctgtaatcccagctacttgggaggctgaggcaggagaatcacttgaacccgggaggcacaggttgcagtgagccaagaccatgccattgcactgttgcctgggcaacaagagtgaaactctgtctcaaaagaaaaaagagacagagaaaataagatctgtatgtaatagttggatgacaaaacccagggctcagacaagaatctagattataccagcttgaagcagatgagaagcccaggaacataacctgaatgacatcataagtcatggggttaacaaactgacattggtagtgtaagagtccaaatccagataaagagccaagatccaaaacatatactgtgagagcgacagtaaagaaccaaactcaaaaaaacaaagccgtgggaggaaagcaaagatcaagtagtagcaaaccaagaaatgatgtggaggctgtttgttttcttaagcaggtaatttcgtttctctgaatctcaatttcatcatctaagaatgtagagattcagttatttgcaagggctcttccagctttaacatgttttgattctgattctagaaagtgaaaacacagaggactaatgttaaatcccgctatcgggagctgtctagtctcatgagaaaggcagaccagcagtcaggcaaataagacactggtatagaatatttaggtggttgtactgcattttcaatctttataaattttctaggtcttggacatacaagaggtagaaaagtacaagtaaactttcccttctaaaaaatcaagactttattttgcctataatatacagataaaagatagtggtcagactggtaaagagtacttaagtgagcagtgtaggaaggaagaaagaggtgagagaatgagaaggaagatataaagtttttaaagtaagagttgttaggaaacaacttctcctacttcaaagagaggtttagacactaacagcaaaaggggacctgggagtgggggaagatagatggtactttaaaaatgggggtagacttattttcctgcataataacaaatatatttctcatccatgcatatatgtactctcccatagaattgatgtagacatagggaatgatatagcatattttagacagcagttcttggtatcaaattatgttgaacatgctttaatggtatgacatgaaattgtaattaattctcacctgcttattccttaagccaaaaatcactaagccacctgtggtccacggaaaattattttattggcaatgctgtcatgagcctttccatagcccacccttacatattttaaacccaacttcatcccctcgaaaagcattcctattgggcctgaaacagctacacctcttccctatgtccttgaagctacttttaacgaatagctaagtgggatgactcccctgtggagtgatattccaatgatcatttttcacttatggagtcctgtttttgctgtaatttctttcattttaatatttcccattaacttgaatcatttatgaaggtaactctatgccaactctcagtgaccagacaaactgaaaacaaatcagtgacctcttagaagctaatgtgggaaatgtgtcctattgctcccaataggatgggaaatattaacacttagggtaagaggttaataaaagctagaacctaacgttgtaacaaattcattcatagagcagaaatgtattttaacattttgtaatacatatataaaacatttataaatatcaactaatatatatttaatgaatacagcaaggattctactgcctaatatctaaatattatatttcataattatgatctgctcactgggcagcatttcacagatgagaggtcaaggctgggaaaacaatttctagaagcgtaagccccaaatgtactttttatagcattttagcaaatcagattactgtatttacccatgttcatctctatcccttaattttacaaaggaggtagtcttataaatgttttagtcaaaagatgtctactgagtacctcctgtgtgctgagaagttttaaaggacagacagaagttggccaggtcacaaaatgaggttgaccttttcaggcagtgggaatcacatatgcaaaaacccagaggcatgagagagcgtggaattattgaagaaactaaggctagtttagtttaaccagagtgaaaggtgcctgttggggagttgagggcagagaagtaggcagagaccactttatgaagggccctcttatattatctgtagaattcagactttcttctgaaggcagtggggagcatataagtgacatgattacatttgcatttcagcaagctaaatctaacagcatcctgaaataaagattgattgaggaatggttaaatctggagacaaggtagttgattaagaggttatttcattggctcaaatgagaaatattggtttactaaaattgtggaagatgaaacaagatgacgggggagaagctgcatcaccagtgtgagcatgaactttagagtctcccagaaataacttttaattccagtattgacctaaaatgaaaaagctgaggcaaaattaatattagtaaagagttcttttgggccagtaaagagtttatttgggccaagcttgagggttgcacttgggagcatagatccaagttgccctgaatatacactccccttagcagcagttacaagtggatttttttaaagggaaagtagaggcagttcctgagctgtttaccaataatttatattaaaataacatactctggccagtgcagtggctcatgcctgtaatcccagcactttgggaggccgaggcaggtggatcactttgagctcaggagtttgagactaacctgggccatgtggcgaaaccccatctctactaaacctacaaaaattagccgggcgtggtggcaggcacctgtaatcctagctactcggaaggctgaggcaggagaattgcttgaactcaggagacagaggttgcagtgagctgagatcgcaccactgctctccagcctgggcaacagagcactccatctcaaaattaattaattaatttaataacataaaatacactatggattgactatatatttttctttgcatcaaaattccaggaatacgaatatattggttgaggcagctagtgagaaacaaaatgacaacaattgccccaggcatggcggggggcatgactgaagtctcatacttatgtctttctggacctgcagacctcacagagctcagattggtcggagctgtttttcttttctcaccagcaataccatttactatctatctctgtggctttagcaagttattaacttccttgaggctacagtgatgtggcacagtccctgacatgagtgtgtatttagcatgctattatgatggtccgatatacgagattggtgaccacttatatgcaggggttgatagaaaggacataatctacagtaactcccataatttcccttcagataaagtggtcagtggcagccaaagcccctgataagttgaagagtgatataaatggcttgtttctcagtaataagagaaaaagtatacaatattatttgtgtacttatttatatttggggatatggtttagaaataggaggagaagctgtgactgtgaggtagagaactagggaaaaaagaaaagctaagcaaggttaatgagacagttggaggttaggagttactctttgtaggttctaactgaaagctaatgaacgatttcaaggatgcaagtaatgtaataaaatatgagaaatataatgagtcaaaaaatcataggatgctaaagctgaaatggactacagagtccattatgttcagttaacactatggctccagtatcttgcaaagaacgtaagcattgctgcacaaaacctaccttgttgttcactcaactcattatctttctgggcagaaactttttgaaagtatggtggtgattttccacgaaatgcttctacagagctagagggatcatttgataaccaattgtagatccatcattaaagaatgttagtaaacacctcttgaactgatttagcttatgtttagaagttcaactttctcctgtataaatctctcagtttaacttatactgcatacctaacttttagctgttggcttttgttaatttccacctgtcattacaggacataatttccattgaaccttcctttggctctttttagttattttttattaaaaaaagatgtgccttaatggtcaaaatgcacgcaaccatttgttttcctcttacatcgactaatgaccaataataataacatctaaggtttattgcatacttactatttgctagacattgtttcaaaggctttctggctggctgtggtggctcacagttgtaatccctgcactttgggaggccaaggcgggaggatctcttgagcccgaaagttcaagaccagccagggcaatatggcaaaaccccgtctttacaaaaaatacaaaaattagcccagcgtggtaatgaaggcccatagtcctttctactcaggaggctgaggtgggaggatcgcttgagcccgggaggtagaggctgctgtgagccgagactgctgcactccagcctgggtgacagagccagaccctgtctcaagaaagggctttctatatgtaaattcctgtaatctttacatgagatagatactgtttttattcctattttatgaaagaagaaaccaaagccagaagacttaagtactttatgggtgatcagacagcaagtgaattacagagcctgtactcaaacacaggcagtggcagtctgagtctggagcccaagctcttaaccacctcatcagactaacctctaacttttgctggctaagaaactgacactatattgaacattacacaacactggtctattcagatataattatgattcccttaacaatatttatttatctcattttgcctctactaaagccttcatacaggcagttatttttgttttgacaattgccttaagatgcatatgttttcatttgcccaaattttgtttaagtttttgttatgaacatacacccacggcaatggcaagagttgcattaaaagagggggaggagggataaataaataaataaggcctcccccacttcttgtatctcgagggactctgggatgtgataaaacaaaacactgttaaaaattcatactagtaacttgcattgtatattatgcactgcaactaaactttttagtgtctcggcaaagccctagagcagccgagaggtacctcagagcacagaaagcacatttgaaatggtaatgagaagcgagccccgtgacaaagtgctagtcggtgaaatatttctctgagacaaacatatatttggagagggtagaaagtcattgactgctgccataccatgacctattttaatgttttcttttttttttgtccacactatactcagttgacttcacagagggcacaattttaataatgcaataaatgccaggacatttgaagtttgagagtaacgtgttacgttattagttctcaggatgtcaactttgggtttcattgtttggaaacagcagcagatcctctattaaagtacttccaaggtttagaatccttgaagtaccactctgttttaaagataattccgaagttcttcttcatcatgccttaatagactgtaaacttgctttttctctggaccattggataaacagtgagtgaatttccttacataacaccattttgctggtacaaagtttgttaaagtctcagtcttctgtttgctaatgaataaaataaaataatgaaaaagaagccgcttccaaatttgcaagagtcattgagtaccgtttctcatcacacacatacatgcttcaatatttagtgcagcccgtgggatgcttgtacaatgagctcccttaaatcagctgaactttcaggtgctcgaggttttgttcagaacttttgagtaagagattcagagagagaggatgcctaggaagctcttagtttgagccctgagaagaaatttaggctagggaaagaggaagggtgcagtgggttgtgaaactaaagaaacactctccagagatagagcactcaagacacagaaaataaagtcgtgagagtgttgctttcgggataaggtaaaaagacaagggaaatgcagatcttcaaaaattgtccttgactaaggcaaaaacaactctggactggccctgcactaaatcatcacagcccattacccccaggagctaaaaacgaaaatacctaaaaacgtggaacataagcaaacaaaagccagcatggaactccagtggcttatgacatatatgtgatgctcttagcccccctgcagaggttttgtggagttcagtgtccaaactttgtaaaaatctttgtgtgtataagaggtgggaatggtggtagataggctccacaacctgtttagaaaaagctttgattttttttcttcattatacgaataccatagcccttcattaatttgggaacaaatgagttcacacgcagacttacctagcatcccagtaaacagtctttcccctgcaatttgcaggatcacagcctcttgcaacctgagtcgacccaattatttctgagatcaccaagtatctcacatgttcaagatcaatcttttcatgatttccattctaaaaattatgttgatgatcactacatggcaagaaatccaggtggccattgccataactaatgataccctctttgagtgaaccctttcctattcaggactcccaaagccacccatctctcaatgcacgacgttgctactgcttctcagttctcactgtgttgccagagccatactatgtaccaggcagaaatggggagactgcccctctcccctgttctgtgtcaaatgttttcgctcagtttctgaagcagcaccacttatgctcctttcttcatgaactccttcaacctttgtcagctgcacttatcaatgtatggactcagggagccaggcagaggacatgtgtcatgccaagccacgtccttatttcttcatttctagccccacacatttcccaccacaaatttgcatatgacacatgtcctcaaacacctcttcctgctactttctattcaattaactaatgcaaataaactcccctgggagatgttatatttccccatgcccactcttagtttacactaagccgggaccacctaactacacaggtgtcccaagtgccaccgatagtactatgtttgaggtacgggggctgaataatttttcccaggttttatgaactatcaaaaggcacacaatgaataaatatttatgaagatgttttaattttgggagggatggggtagacgtagatagggtttgtgatgaatattgcccacagattataaatacagataacatacaactaagagcctaagcaggtctaacttttaagtttagagtgagaacacttacaggaaatagtgaagttgtccaaactaagctctcttttgtccttcatttgaatctctcacccactaccttttgttgccttggtcccttttaaagtagaggccactagtctatgtatactatgcccctgagatgaggaatatggtggcttgaagaatgtaatatcttagaggacacagagtgtgtttcatgtgtatctttccatcatctagcatgtgtgtactcccaacgaatattaaaaaatagggtgtgaccctcttaaccataagagatgattcctcattttgagatgacgtgctctgggaataaagaatgcttccttcattttccgtgactgtcaaactggcatctttcatcagcactaaattcccttttaagtagtcaaatgccttacacagttttaacaggaaatctctcagcacctctagctatttgttgaaaagaaaacaactcttttttttagatacatcttgcagaaaaccatttcccaaataaaaatttaaaagtgttatcatatttagagggaaagaaataagcccctgaatcatagtgccagtttcatgttttccttaatgttgcaaaggtgattatttttgccataatcttcttctggctgttagcccaggatggcaggctgcatagctgccttgttaaataaaagagaggggagactttcttgaagccattttttagaggatttgtacatatgtgtgtgggaagagtgtgggtgaaatcctcaggacaaaaatttcccatctactacttccataataattcatgaaaaaatgagttctaccacttgttattaattcaagtcctggaaatatactctaatcatcaatatcgtttccaaagaacatataaatatagtggtgtgtttcaaactaccaaagaacttacactcaggatgcattttgcatctttctttcttttgttttctttctttctttcttgtgtttagctggaagtcagtgttgttaaataaggagagatacaggcatatacaggatggattagttccttgccctcagccgctttaataatgattttttacattttttgatctattcaaatgtgtacagtgctaaaaagaaatttatttgaaaaggatctaattggcatgagctgccattgctgtcacactgaagtcctgctgacaaggctgaggttggcagagaaataaaagcaactgttaatgtcagaaatgagttgtggtaaaacatactgtttgtttaatgttgataaaagggcaggtggaaagtacatgaaattatcttctcagagagttcttgactcataaactgcaaatgctcactagaaaataaatttatgttttatttagttgtggctaaaacaatataataacaactatactaggagtatagcatagagcgggcactgctattatccgtgcttgtgccaaatagatctaagaattgtaaagaaatgtgtttcaataagatgatattctcatgtatcctatgactattataaatacttaggtattaatatcagagcagaaggattgtggtatttctgaaactaaccctagattaagatcatttactgttagaaatgaaaacattgttgaaaaactgtaaatgtttgttaaaacctgtttttaaatttttttatattcagttttaacatctgttacatttctttctgattactcttaaattggccatgactcctgattgtttatcataagttttaattctctactttccttatgtcatctgaaaattgtagcactggggcccttcatattttaaaggttgtcttctgttgaaatatatacatataaaggattgacctgcagtgtaaataataatttacctctttttatttattctttaagcctgtgttaaatatattgagttttcttaaagagggaaaacctgtgaatagttaactcaggccaaaggtattttaagttgtatgttaatttctttatgcagtaaagctatgaagctctgacttggcattataactatgctcttcttggaataataagggtacacgctgcttatccgattgacacttctttcaaaagcagaagatatttttattgactttggtggcaatcccatattcagggcttcctccatataaaaaaaaataataatgtgaaccttgaccacagggaaggtcacagaccttggatagaagccaaatatctgtgttttgtttagggccctcaagcaaaattttcacacaggatttcctcagattcacttcactgcaaaataaaggcattttcactccctgccaggtttagcatgagaagcccctttgttgtggggctgcttgagcagtatttacacttccttattgagtacctgcaaatgtctcagctagaaaagtgaaagtaatccaggtaggcttgataaaaaattttaaaaaccaactgggcgcagtgactcatgcctgtaatcccagcactttgggaagccgaggcgggcagatcatgaggtcaggagttcgagaccagcctggccaacatggtgaaaccccgtctctactaaaaatacaaaaattagccaggtgtagtggtgcactcctgtaatcccagctactcaggaggctgaggcaggagaattgcttgaaccagggaggcggaggctgcagtgagctgagatcgcgccactgcactccagcctgggcaacagagcaagactctgtctcagaaaaaacaaacaaacaaaaatttaaaaacctgcctaaaagttttagcaagttcatctttcttggcttgctttactcttgcaaagaatctgtaatttggagagaactgactcatttttgctattagaaacatttttttttaaacaccagtaatggaagaaacaaccaagggatgaggaagtgagcaaaaagtgtgaccttcccaaatattggtcctgttaataaaactcagattctaaactgttgatgtcaagtcatttttaaatgttatttttcctaatttttgagaaaatagatgatcattttagaaaatgtagaaagtacagacaagtgcatttcaaaagtacagaaaaatataaaaatgcaaggggggaaactattctgtcacaacccagaaagaacaactgctaacattttggcttatttgcttgcagatttctgaattttttacataatttggatcatattatttatgtaatgttacatcttgcctttcgtttaacacttgccacatgtaagttctaacatctgtaaataattttttggaaatcattttaatgactctattatggctcataatttacttaaatattcccctaacagtggatatttagggtgtcttcaattttttggcactctaaataatttttttttttttttgagacagggtctcactctgttacccaggctagattgcagtggcaccatcacagctcactatagccttgatatccctggctcaggtgattttctcacctcagcctcttgagtagctagaaatacaggtgtctgccaacacgccaggctaatttttcaatttttaatagagacgggtttctccatgttgctcaggctggtctcgaactcctgggttcaagcgatctgcccacctaggcctcccaaagtgctgggattacagttttgagccactgtgcccaggctctaaataattctacattgagcacttcttgcatgtatctttgcctacatttcaaattatttcagcagtagagcttccagcagtaaaataataggtcagacagaatagacatttaaaaattttctgctatatggtttcaaattaatttacagaaaaacttaactaaattatgttacaaccgatagtgtatgagaggacctattactcactttcaccagcactgaattttatttttttaactgtgttaatttggtgagcataattaccatttctttctttgaataattttcaaactaatgtaaactcaatggcacacctgacggctacatcctacaccacaggcccttctgaaggagacaaggccctttctttacagtaagaatcacctattaagtatcgatgcatgtttgaaataatatttttaaagtatattatgcaaacatatataagttaaatgcaaagagtggttaattggggattagaaagaatcaaaaggaaaaacatttgcataattaatgcttgcttcttttctttattttcaatcatggatattatagcccacaggattaaaacttaaaatgtgcagaagtagcatatctgaattgtttacatcttttgaaattgatatgtcctatccagttttccacctaaaaggagacaaagaagctgggcacgatggctccagcctgtaatcccagcactttgggagactgaagcgggtggatcacttgaggtcaggagttcaagaccagcttggccaacatgatgaaaccctgtctctactaaatatatatattatatatataaaataactgggagtggtgctgggcgcctgtaatcccagctacttggggtgctgaggtgggagaatcactggaacccgggaggcggaggttgcagatcttaccactgcactctagcctgggtgacaaagtgagactccgtcaaaaaaaaaaaaaaaaaaaaaaaagaaagtcagcttatgtatgaaaaagaaatttgttgatttctactaatagaatatcatacaatccaaaatcaatatataagataatgttattttccttactttcctgtgtctcgtcacgttcccatttcatcatttttacttcagtgtaagttacctttgtgtaatgaggaagaaatctctgtcctttttaaaattttatttttggtaaggcaagatttaggatgtggggttaatttatttctggaaatcctcaagttggccaacatcccaccctaaagaggaacatgaatctgacattaaagtgtgaaaaggtaagaagtaatattgcacattagtagtactacacagtatatggattgtgtttttaatattcaaaatgatatcctcctctgattttatctggacatggtaagaacaactttgcagtggttaagagtggttagattttgaagccaaacactcatgattccaattttgctgctgccttttaccagctatatgatcttagacagtttaacatcttggaaactaaatgtgttttaatctgtaaaatggaaaatgttattacctctcaagctggatgcaaagatcataaaattattgggaattaggtatagcacacttttcatcgcagactgcctgagtacaggcatgtatgtggcactccttcttttacttaagctgtttggttcttccttccatcaggtggctactaaccacacttagtgttgtctttttgtggctgtctatgaagtgcataaagaaaatgtgtaaagtgaatagagcagttaagaaaaatagatgctgacagatccatgacatttgcttcatttaccattaatcagctgagttaaataaacagcaattatttttctttttttcctttcctgtcaccagacagttaatcaaactgatttcagtttggagtttgcaattttctcttaaaagtttttaggaaaaattttgtcaaaaaagcaaattcctcataaaatattttattaaatattgataactatttcaccctaacattttgtgcagttaaatgtaaatgaaataaatgtgaaggcatgaagacaaataaagaaaggaaggaagtcctataatgtaggtctggttaaataaatcatggtgtacctataccatacagcattatgcagtattagctgaaatgctttagaaaactggcatggggtgtttttcatgatatgttaagtggaaaaaagctggtaataaaacagtatctatgtgatgatcataatttcttgaaaaacatagttatgttttaaatcaatgagaagaatatccactcaattgttatgattatgattgcttatgattgttacctctggatgacaagattttttttcattcattacagaattttatctttagtatagcattttaatattgtttctaaattttatctttagtatagcattttaatattgtttctaaatttgtgtgtgaaacctatattacttttgtaaattttaaatttttttcacgaggaaaaactaaatctataagagtagtatactcacatactactcttttggggtccatagttaaaagctactttttagtatttcgacttctgtattttaattttctcctttgccgggcaaaaggaattaagaaatgttaatgataatgatatatcaaaacacaaagacaaaaaaacttaagtagtctgctttgctccaattttcctattttacattgatttagaatgatatgcaaaaaataataataaatcccagcccaagatcccatgtgcaaatttgtcagtatatttatttgtttctacataatttatttgaggatcagctttactcaaatgatcactgcctcatgccagactctgttataacacatccgtctaattaatttctctgaaaatttcacttgaatttccgtttttaccaatgcctattgccctttagtaccaaatataacatgtagatgtctaccatattataggaatagttgtgagatatgaagacaagtaaaagaaaagcaagcagcttagtataacagtgtaggtgttagactcaaaatagtacttagcctattagcatttgactctagcaagactttgcaagaggacaaaagttgttaccaatgagcgttttcccacaacccagttaggacttggtcataagtagaatgtaagctcttcagctatcatccattactttcctatatcttcttggttactatgaaattctggaaacataagacataagatagcaggattgtaggtaaaagttttttgcattcaacctgttaccgattctgggtcctagattcttttctgcttctgttgcccatgacaaatgtgtgcttgctccaggcttattcagctgcaacactggattatagacaaacagcatgaagctcaaatgtcccagtccttcgctcggtcaataagcacttcttgagagaggcacagtaccagcactttacaggttacacaggagaataagatatgaacttactctctggaagcttgctctgctagaagaaataagatatataaaaacagggcttataatatgaggttagaaaatcagaagtcctttgagaaaggggcaaataagttcaagtgcagtggaagcttgaaggtaaattggaaaggatttgtggagaagttccatttcagttatgacctacagtacaaggagtactttggcacaagtgaatggatgcaacagacacatgtaataaactctttaaacagtctctggtatataataagcattagctacatttgttagagtaaaaagcttagttgctgtaacgaaatgacacaacaaagattgtttcatgtaacagtccatgaggtgtgagcagacactgctgcacacagtctgtcactatgcagggaccaggattcatctcttcatgttcttccatcatcctctaaaaccattgttatcatctgagtatttgaaacgattcctaccacatcctaattctagcaaggagaaaggggaaaaagtgttaggagtatacttgtgatgtgttaaggcttccattggtgagcacgtagttgcctacctgaactggggctggaaagtgtgttctctggctgagcagtcatgtgatttctataactccattaccaaggaagaaaaagaaaacagattttggtggatagctaatagtctctgccccagctattattattatcattcttgaacaatttgttactatcatcaggccataattgtaccctagtaatctgtgatggctagttcatctccccaaacagtgaattttctactgtacaagtggcttaagcccaagatattcttgtcactattcccatggaatagaattcaaaccattcccaaagcctagctaaagctatcactgagtaaaactctcttagcttcttaaagttcatatatttgtccttaagtgacctaggctgtgaagaaatgggtgataaaagtgtgaattacagaaccagtgcttccacctgcactgaattctctgctcttctgaagaatatttctcacaatagagtgtcaagggaagattggttgaacggttttattctatactaaattcttctcttttgcttttaaagagtcatttgccagaagaaaacctcttcagcaagttcatttcaacatttcaaataatagttctcttttcatgaactattttgtagaaaattacatgggtaataatatcatgggaagagtatagctttcatgatgtgtattttttctaatcgttctaatttttcatggtaatctgaagtgccatatcatcttacccaagctcaggaattgtaccaattggggattttgagtgcttggaagaaatgtctatttttaagcaacttttcattctctatcctgttaacatagtgatttatttgtgactcagaaatggaaggacaagccacctctctgtagtgatcacctgtcttatggaatcttaattgcaatgctaattcagtcttggagttagtgagatagtcaactaaatgataagtacaagatattgataaatgacaagggaagtatttagtaagtcattggtaagtctgttttatcttaatgtgttgagaaatttgaaaattaggagaaggaaataagagcatatttatgaaattttctaaagtactgctctgtcccagatcttgtggtagatgctgtggagggttacgtaaagaagggagattgagctcagcctttggttaacctttgccttcatctaatagaagacaacatgtacttaacaaaaggggaagcaatactggtaaggcaatatgttaagtgtaggttacatcagaaggcaagaactggcctgcaaggcagaagatctggttctcaggaaggatatcaccaactgaatatgtgaccctgagtaggtttcttcttctctctaggccttagtttacccacctgcactatgagggagttcaattaagtggattatggcccctaacagattatgtgattatttgaactatgtaaccatatacatagtataaaatgcttacttacattgagagaatgcagagtactgagactaaacagtacaagtgtgaggagttcacattctcactgatgacaagccttaatggacaaagattacataagatttttgagtgattgcattcaatgaacttcaaggacccttctaatgctgggactttgtgattcttggtaaaatgtgagatcccacttgctcactaaaaatccccagaagatctaaattggatgctattttcatgtctgtctctactcatcagttgaattggagagaacccaaatgaaatgaataaaaatggaagatctgtggtgggggggcggctgggaggaaggatttctttcactttaggtaagataaaactgtataaggaaagacatgaaagtaatgtatgacttactgaaaagtgtaagtaaaagccagtaaggaagcaaaatgggttgtctgagaccgggaagaattgaaatgaaaatgatgggctgcatgttggagaactgaaattaaggcaaaatactaggacaaaaacacattgacccatacgtgaaaagggaacagagccaggcggggcagctcactcctgtaatcccagcacccagcgctttgggaggccgaggtaggtggatcacttgaggtcaggagttctagaccagcctggccaacatggtgaaaccctgtctctactaagattagcctggcgtgatggtacacacctatgatcccagctactagggaggctggggcatgagaatcacttgaacccaggaggcagaggttgcagcgagcccagatcatgccactgcgctccaaccagggaaacagagggagattctgtctccaaaaaaaaaaaaggaaaggaaaggaaatgttactggaatattttaaagtcatatagcccagtatcattcagattaattaaaaatcttggagcttgacaatttcgtggtgctgatgagtgagagagggctaagattagcagtagctaaagaagggaagtttcctacaattatgtaggccagaaacagtttcccccaccctctcacgccgtatgttctcttgcctcttgcctgaggaagagccactattggtaaagtttgatttgcacaattttgtagtaaagaaataattagagtttaagactgtagatgtcacaccactgagaccgtatgatctagtgccaattctagattctggtctatactctgccaatgataggccaagtcactaaacctctcccacataagttttctcatttaatcaatgaggacagtcacttcatggggtaaaatcactttggaatttttaaggtgcaatagaaactcactaatttcttgtaccttctttctgttcttcctcttattttaagtgacttggttcataagactgtgcaatgaaaatatttttaaatttaggacttattcaagcacccagatggtttgaaattcagatgaatttcaataattattttcatgctagccattcttgattttgctgtcaataataacacatagtcaatttaaattacactgaaatttgtggttgaacttttaaatctttgttggattatatgaaatttatattttctccccagaatcatgtcatcattgtcttattttgcctgacattggcctggggtgcatacccttgcaataaccttactctgggtttactatgcttgctcttaggcaaattgtttagtttgtttttaatgtttaatgttacacaacccaacagctttctgttgtgtactgacctgaaccaattttatcatgcagaatgcttaggttctttttgataaataatggtaacctccaaagaagtcttacggtggttgagggtgactctctccaaaatctcactatggggttatagtcaaagaaaatctcaaaccaaatcctaccacaaatgtttattatttaaacatttattagcatttcagtacataaaacagttcatgtaacctgttctgtaatctcaagaaaatcctagttcactatcctttcaggtatcctttcaggtgctttagagattaagagagacaacttctctaaaggagaattataaagagtgtatgtcctgccatataatagattttcctaatagtgagagaagatatatatagccatggtattaagttcagagatggtgtatccttggacattggtttattgagaaataattatgatgacaatgataatgattttgaaaataacaataaaatagcaaccgcattaccgcctcacatttatacctccaaaagataaatttcgcaagggcaggaatgttgttttatataccactctatctccagcacatagcattttgcctggaacatagtaggcatttagtaaacttttgttacatgaaccagtgaacaacagttacggaaaacagtttgacaaactgatgagtcaggcagtgctctaagctctttacatgcattatcacattcagtacaaatctgtgaaagagccaagctaaataaagctttcactaatatcagttttcaggaaatgaagtatactaattaattgaattttctggttaacagagcgttacatttcaattttttaaattttaatccttttaattgcaattaaaaaaaaaaatcagtgacagccctgcctcagtaaatagaatctagaagacattcttgaattttaggatagctgattgaagattttctcagggccccagatgaaactccaagcatcaattgttttatgcagtatcttaaacagaaaatgtgtaatataatacattagactaaatgtataaataatgccataacattctctagaagttgtttttcttttcttttcttctttcctgggggtatgggtgggattatgttgttgaagctttaatattatcttgttttcctctgccaactctctcattcccttgtacatattttatggagagccagtaaatagagcatagtggagaaagcgaaggctttgaagcaggaaatgactgcattagaatctttgttctgtcatttaactgctgtgtaatttgggcaagtttcttaacatctcagagccttagtttcctctcctgtgaaatggaggtaaaaccacttagtataagatttcctatggcgattgaataaggtcctgtatgtaagggtcctctgacatagctgctgccactactgtgagaatcccaggatatagggtctgaaggcaacttaaaaatatataacttgcttcaggaatacatgaaatatgatgcacaagtaaaagaatattgtttgaaaatggcaaattttaattttactataaagacacatgcacacgtatgtttattgtggcactattcacaatagcaaagacttggaaccaacccaaatgtccatcaataatagactggataaagaaaatgtagcgcatatacaccatggaatactatgcagccataaaaaatgatgagttcatgtcctttgcagggacatggatgaagctggaaaccatgattctcagcaaactatcacaagtacagaaagccaaacaccgcatgttctcactcataagtgggagttgaacaatgagaacacatggacacagggaggggaacatcacacattggggcctgttgggggttgggaggctaggggaggaataacattagaagaaatacctaatgtagatgacaggttgatgggtgcagcaaaccaccatggcacgtatatacctatgtaacaaaactgcatgttctgcacatgcaccccagaacttaaagtataattttttttaaattttaaaaaaagaaataggaacattgtttgaaaaaataaattaagctattattaaaaataataataaaaataaaaagaggaaaatggcagattttatatggaatgtatacaaatgattaattagaaaggtactttgttccatttgtagaaaatgacaatgataaaatactaatctaaggtaatttttttgaatcttagagcaaatggtccattttataagttttctacaggaaaatgtattaattctgaaaccattaattatttatgattatgagtacagtggctgggctgcatctccttgttctgtttaagctgtggattgataagcaaattcagacatgaaataagatgccagagagtataaaatgtttgagagaaactaaagtgttttcaaacactttataagcactcatttacatataaataacatgcaaattatgagtcattcttctgtatttccaaaagcaagtgcttaaagatattttattagcctatgttgaactattgtatactttgaatatggtgtgagtacacacacaaatgcatgcattcatatacacatacatgcattcatacatattatgcatttattttttaatgatctgtagttcttacaaactttttttgcaaattggtctgagaaaagtttattttgtgtattttgttttatcaacacctattttatcatctcctttcttcccagtgatgctgatataactaccattttatgcccaatgattgattttgtctttatggcagctatatgattatctttgtgatcatctcttgaatatattcacaaatcaaataatttccaaaatattcaagaagaaacacaaacgttttctattcattttcaaacttcaaacccaattctttttcatcaacacacttttacaatattttaaaattcttttacttacttccaaatctacttaacccctaaagaaactttctttaaaactgcttaaaattggaaacaaataccatttttcatacagaggaatccttctctcagctattttaccttattttgttgcatagaagtctttctattctatctaatatttaaataaatatttacagagtctcttcagattgtttcattcaataattctgtttcactgaaccattcgcaatgttttaaatcagctttattttctagagtacagtgtttaattttttttctttattcaactaaagtactcttttttaatgaacagagattctgttattattgaaaattgactctaaaatatgaaatgctgtatacatactgagggtattttaaagaaaaaaatagaatctgttttgcttctgcccataatttttctggcaactatttcaaaggacaatcgttatttaaaatttaatattgtctagtgttttagaaagtcccaattagaacattaaaatttgttgtataatgaaatcaatgttggaaaaaaactccctagttttagcagagcaagtcagttgtgtcttggttttaggtaagcttctttaatgcaatgttttattccataaaactgaaaattgtcttttggatgctgaagaacactatgacttccattgttttgttttataatatgtttgcaattgagctacagcatataatttgatagaggataaatagagaataaaccttttattttatgcacattggtttcatgaagtatataaataagcatttctaaaaccctgagctgactctgacagacccaagatattgatgcagtagcctaccagctatccacagccatgcatagcctcttgaactcctcattaggaaataatgagggaacagtcataaatacatgcaattgattatgcattactactgatgcttacatttgctttcagtactgtttaggccaactctaaactttaaattaatagtttgcagcatttactgatgaaaacattggatatacaccatctagacagaaataacttgtttgtttgatttagtgaaaatgttaaatactgttaggacttagttaccacaaacctggcattggaggctactttcagctttagcttatacccaaagggctgttaaataaggcaggtcaggaactggaattattcctggccaatcatatcctgcccctcccttttcctttatcacacccctttgtgtttaccctactctatcagtaaaggtctaaccaggaaagtggaaatataaattaaaacagggagactaatggaacttggttacgcaggccatggaagaactgagaagctgaatatgggacattgcagccacctaactataagcaacaacagggagcaacaccaatgcatctagggtggagggacaagggaagagtcagctgatatggaaaccttggaatggggagctaggataaggagcagagaaggagaaatatgatctaaggacatggatctgaggacaatcagacccaaaacaagcacagttgtagtgggctactgtaaggaaaatgagagaacaaaagtgtgaaaatgagtttgaacccctaagaagtgaataagccatgttaataataataaacaatagcaataataatggtgatgacgataacagcagttaacactcatggagcactctgtatcaggcattgttccaaacacattatccattatgtctattttgtcctaacatagcctagtaagttaggcactatcttcattgtgcagatgaaactggggtatagttatttagcatgtccaaggtcacatagcaaggattcagacctaggcagcctgactctagaaatgaagctgttaacttctgcactacaactgcctcccaaaaggtaaactatgctgtctccctcttggccattctatccttcagccatctatacaattgactaggtcttaaattcatttgatgacactatactaattctgttaagaaataataaaatcattctcatgcaatgcagctttcattaagacacttctttttttttgtaataggtagcacatgcacgtggtagaaattattctggtattttttgaaccatatggaattgctgcttttttatgtcaaaaaagttgcatattggcatttttttatagttcaacctaatgtagagggcatgcagtaaaggcaaatatctccctcaccccagtttctctgaaagccaccactccctccggtttctaaagtacctttagagagatattctgtaaatatacaatcacatatgcagatatttgcctcttttctgcccaaatagaagcaaactgtattcactattcaacatcttgcattttgtcacttaacagctgctgagtttccagttgcacaactgtactataatgtatttaaccagtacttctcaatggaaatttaagttggcttcattgatttgttattacaaaaacatactgtagttaatatatttatgtgtgtgcctttacacatgtaaattactagaagtggaatttcttcctaggtatctgtgcattttttattttgataaatattaatgatattggacaaatattgtcaaattgccctccatagaagtttgataaattggaattcccattatcagtttgtgagagtacttgtttcttcaaatacttgtaaacataaggtgttatcaaactttttaatcctgcccatctgataaacactaaatccaatattgctgtatttttattttgcatttattttattatgaaggagaggcagccatttttcatatgttcaaaagtcagtaatattacattttctgtaaatcattcagattgcttactatgttggattgttggtcttttattattgatttgtagatactatttatatattaagtaaagtagtagtcatttatttgggatttgatttacaaagacttttcccagtttgttatttgtcttttatcatttctgtgggtatgtgtgagtgtgtataattgtttttttaaatgttccatgtaatttaaaaatgcccctcctggaaaaagcaagctatacctgttaatcaagaaatctaaagaaaaaaaagttctatttttaagaatttctaaattggctggctcatttgggctgtagttgagaaagttctagtggttttacttattttaatccaaactactttcttacatcatgtatttccatttttaatttacattttttaattctaaagatgattttatatatgtgctcattgtatacttggaaaactggcatatgaggaaggaaaaacatttttccttgttaccacagtctattcatataaaggtaaaaatagaataagaaggatcaatgaagtccttcagcattttttttattgtgatctctgtttctgatttgtagaaacaatttgaaagtcttttcccaaaagtgatttataaaaagttatcaagttttgtgataatgatactatcactaatcatactgacaaattcatgacatttgctagatagacgttagagttgcatggatctataggaatgtaaaataaatcttcatatttagcaataattgagattacttgtttcttttctttcctgacacatatcaatattttaacaaattattcataatgatacattaaatgctatcttattttagcttgttcaaatttttattattcatttattttcaaattgacagacaaaattatatttatcatgtacaacatgagattttgaaggatatacacattgtggaatggctaaatctagctagttaacatatgcattaccccacatagtcatcatttttgtggtaaaaacaccatatccattctcttagcatttttcaagaatacaagatactgtcattaactgtaatcaccatgcttcataatagatctcttgaacttattcctcctatctaactgtaagtttttatcctttgaccaacatctgctcagaaaatacaattttcacttctggaaaaaccattctcaacctcacagactttggtagtcttcattctattatactctctacttctatgagatcaacttttttagattccacacatttcgtttaacataatgtcctgcaggctcatccatgttgtctcaaatgacaggatttcctttttcatggcttaattgtattctattgtgtatatatgccacattttctttatcaattcatctgttagtgtacgcttaggttgatttcatatcttgactattgtgaatagtgctgcaatgaacatgggagtgtagatatctctttgccatactgattttatttcccttggatatataccccatagtgggattgctggattatatgacagtcttatttttaattttttgagaaatctccatactggttttcataatgactgtactaatttgcattcacaccaatagtttgtcagggttttcttttctccacgtccttgccaacactcgttatcttttgtctttttttataatagccatcataacaggagtgaggtgatatctcattgtggttttaatttgcatttccctgatgattagtgatgttcagcatcttgctatatacttgttggccatttgtgtgactttttgagaaacactgattcagaccttttgccaattttttaatcaggtaatttgttttcttgctattgagttgtttgtgtttcttagatattttagatattaaccccttatcagatctataatttgcaaatattttctcccattctataggttgtatattcattctgttgattggttcctttgctatgcagaagctttttagtttgatgtaatctcatttttctattattgctttgattgcctgtgcttttgaggtcaaatcattgcccaagccaatattatggagatttttccctgtgttttatcctggtcattttatagtttatccactttgaatttatttccctatatggtatgaggtaaggccctaatttcattcctctgcatgtggataccagatttcttaacaactttattgaagagattgtcttttccccgttgtgtgcccttgttgcctttgtcaaaaatcatttggctataaatccatgggtttatttctgggctctctattctgttatgttagtctatgtgtctttttgaaattgctggtgctgagctgttttggttactgtaactttgtaatatattttgaagtcaagtagggtgatgactccagttttgttcattttgctcaagattgctttgactaattggggtcttttgtgattccatatacattttagaattttttttctatttctgtaaagaatgtcattagtattttggtaggaattatattggatctgtatatcgcattgggtagaataaacattttaaagtattaagtctttgaatccatggacacaggctatctttccatttgtttgtgtcttccatttctttcatcaaggttttatagttttcattgtggagatctttcacctccttggttaaatttatttctaagtatttttttgtaactattgtagacaggattgtttttctttctctttcagataactcattaagttggagaaacactactgatttgtgtatgttgattttttatcctgcaactttactgaattcctttatttgttctaacagcttttaggtggtggctttaggattttctatatataagatcatgtctacaaacaggaacaacataacttctttgttttcaatttggatgccttttatttatttctactgtctaattattctggatagaattttcagtactatgttgaatagaagagatgagagtgggcatccctgtcttcttccagatctcataggaagatatttcaatttttctgcattgagtatgatgtaaaggtgagtttgtcatatatggtctttcttctgttgaggtactgaaatggtttggctgtgtgtccccacccaaatctcatttcgaattgtaatccccacatgttggggcagtggtctggtgggaaatgattgggtcatgggggcagacttctcctttgctgttcttgtgatagagttctcacaatatctggtcattttgataagtgtctggtgcttcctgcttctctctctctctctctctctctctctctctctctcctgctgtcatgtaagatatgccttgcttccccttcaccttctaccatgattgtaagtttattgaggccatcccagccatgcagaactcagagtcgattaagcctctaagcctctttactttataaattactcagtttcaggtatgtctttatagcagcgtgaggattaatacaggtactttccttctatccctaatttgttgaaattgtttatcatgaaaggatgtgccaaatgctttttctgcttttattgaaattatcatatgtttttgtcctttattctcttaatgtaatgtatcaaatttaactgatttgcacaagttgaatcatcctttcattcctgtgatgaatccccttgatcatggtaaataacattttcaatgtgcttttgaagtaggtttgctagtatttcattgaggatttttgcatctgtgttcacctggagtattggtctgtagttttcttttttgctgtgtccttgtttgatttttgtagtgaacccatcaggtcctgggttcttctgtgatgggagactttttattacagaatcaatgtccttactttctattggtcggtttagattttctatgacttcattattcatgaataattgaattgaatgtatcaaaaagtgtatccgtttcttctaggctatccaatatgttgacatataattgttcataatcatatcatgaaactttgtatttctgtgttactagttgtaatgtctttttcatgtctgattttcgtttgagtcttctctcagtctagctaaaggttcgttgattttatcttttaaaaaaaacctctgtttcattcatcttttcagttgtttttataatttctattttatttctgctagttctttattattcccttccttctgccaattttggacttagtttgttcttgtttttccaattccttaaggcaatattaggctgtttatttgagatctttcttcttttttgatgtagttatcaattgctataaactttcctcttagaaattattttgccgtatgctgtaggttttggcatgctatgtttcatgcttccattttcatttgtctcaggaaaattttaaattgcccttttaatttcatcattggcccactggttattccagagcatgttgcttgatttccatgtatttgtgaattttgcaaagtctcttctgatattcatttctagttttataccattgaggtcagaagagatacttgatatgatttcagtcttattaaatttgttgactggttttatgatctaacatatctatccaggagaatgttccatgtgaagttgagaagaatgcacattctgcttctgtcagatgaaatgttctaaatatgtccgttaggtccatttggcctagagtgcagtttaagtctgatgtttccttattgattttctgcctggttgatccgtccattgctgaaagtggagtgttgaagtctcctattattgttgtattgcagtctatctcttccttcagctctactaatatttgccttttatatttaggtgctctgatgttgggtacacatacatgtacaactgttatatcctcttgctaaattgacccctttatctttatataatgatcttctttgtctatttttatagtttttccttaacgtctattttatcttatgtaattatagctcctcttgctctgttttggctttcatttgcatggagcatctttttctaccacttcactttcagtctatatgtgtccttatagattatatatgtctcttgtaggcagcatatagctgaatgttgttttttattcactgagacactctgttttttgactaaggaatttaatccatttacattcaaggtgaggacttactgctgccattttgttaattgttttctagtagttttgtagattctttggtaccttccttcctctgtgtgtgtgtgtgtgtgtgtgtgtgtgtgtgtgtgtgtgtaagtgattttctctagtgatatattttgattccttactttgtatttttttgcatctactgtgtgtctttgctgtgtgggtaccatgatacttacaaaatatcttgcagtcataacagattattttaagcttatcacaacttaactttgatgacaatttttaaaaactctacacttttactgcactccccccacattttgattttttaatgtcaccatttacatctttttatattgcataccacttaacaggttattgtagctattattttaatagttttgtcttttaaccttcatactaaagtataagtgacttactcaccaccattatagttttagattattctgaatttgactctgtatttgcttttaccagtgtgttttatactttcagatgatatcatgttattcattgacattcttttcctttagtttttagcatttcttgtaaacaagatctggtggttatgaactccctctgctttaatttgtctggtaaagtctttacttctcattcattactaaaggacagcttgctggcttgcagttcttttacttcagcagtttgcatatatcatacagctctctcctggtgatagaatttggatatttgtcccctccaaatctcatgttgaaatgtaatccccaatgttggatgtggggcctggtggaaggtatttggatcatggtggtatatttctcatgaatgacttagcaccatcctcatggtaatgaatgagctcttgccctgagttcatgtaagatctgattgtttaaaagactgtgacacctcccctgccctctcttgtttctgttctcaccatgtgatacaccagctcctccttagccttctgccatgattgtaaacttcctgaggccctcaccagaagcagatactgctgccatacttcctgtacagcttgcagaaccatgagccaagtaaacctcttttctttatatattacctagcctcaggtatttctttatagcaatgcaagaacagatttaacacagaaaatggtacctcccccacccttgctcctgctctcaccacataataccctggcttcccctttgccttctaccatgattgtaaactttctgaggccctcactagaagtagatgctgatgccgtgcttcctgtagagcctgcaaaaccatgagctaattaaattgcttgtctttataaattacggagtctcaagtgttcctttatagcaatgcaaaagtggactaacacacctagcctgtaacgtttctgcaaacaagtttgctgctaggtgtattggaacttccttatttgttctttgcttcttttcttttactgctttcaggattctctctgtttttgatttttgacaatttgattatatgtcatgaggtagtgttatttggattgaatctgattggaaacctttgactttcctgtacctggatgtacatctttctcaaggtttggacgtttttctgctatcatttctctaagctttctactcttctatctttcttctctccatcttaaaatccaatgaatcaaatatttgcttttacaatgctgttccataaatcccattgacattcttcattccttttaattctttttttctctcctttgactagatactcttaaataatctaagttcacatattatttcttcagcatgatcaattctgttgttgatgttctctattgcgtttttttcattgtatttttcagccccaggatttatctttgattctttaaaaattatttctatctctttgttaaatttcttattctggttactttacagtttttctcatttattttaattatttatctgtatttttttaatgtggctgagcttccttaaaatagttcttttgaattctttgccaggtagtttgtatatctctgtttttttatggccagtcactggcactttattttgtctccctaataatgtcttgtttctctgattgttcttgatctctgtggccatatgttgatatttgcatatttgaagaaatagttacttattccagtttttttaaattggctttgcctgggaatgcttttaaataataagcccttccggagactccagcaggccctctggcctggtccctaagcctggcatggctgtggccgttgtggtgctaggggagtgccctatgccagggaccactgtagtcggtgtagtactgtggctgagttgggggcagtgctggggtgcagcagaagccccatggttgctgaggcctgcttgccactgacatttatccagggcccacggccactgtagatatccagcagggacacacattgagttcactgcacaagggctatgctttcccatctggtgccagggcaggtctggaggcttagtccatagatacttcattcctctttcacttttttaaatcttatcagcctctgaaaaactagtatgcccattttaccacataactcatttgacttgaatttctactttatgaatttcaaattttttccaggctctcaaggttagaactattatatattgcttctattaatgcctatttgttgttattttctatgactcctcaacgtatttgctattgcagcaatctcctcagcacaacacatttcaaaattattcctcccattactcatgttattcttctcaccttatctgtttttgccatccttcaaggctagcatgtagctgagagagcaatacacatattgtcatatctgagttcctgtcccagctcttactaggtcttagtaattgtgcgactttgagtaagataaatgagataaagcagctagcatatttaccaacacatggaagacactaaatttttttctcccaccctcactccacagggttttttatgaagacttgcctgaatacactctctctcctctgaattgaaaatactccctaggtcacaaaaaccaatgccattttgcaatttttttttgtatttttaattgcaaactatattataaacatctttatgtgaattcttctacttgtacatccattattccctccacaaagcacctcttataacactgaggataccaagcactcaataactacttgttggttggtttgtctatatctcgaaatagaatagcagtgtcaaactttgttatatctattggtaaaatataattctaggaaaacaaacaattggagaacttggttcttattttttcatcttcttgtggtccttgttaatgtctgttggttcacaggtgatgatatacaaaatttaggaagaagaattttcgttctttgttagtggaagaaatttttgttattggaagtcatttttgaaaaccttttcattggttttaggattgtagggggaaatggaatcaaaactgcagtgatttagaatatcataggatagtagaaccaggaaattaacatatttaattatagattttgaatgacttcaaaggaaactcagttttttcaaggtattaagccaggaactgggccgttattataggaggccacttgggcttccatttagccagtttctggcacattcattgacaggaataatttaatgattgtgaataatcaccaagtgtaggaaataaggtcctctttgaatcataaagctttttttaaacatgaaaaatgttatgcatttttttgagaatggtgaaatatgcaaactaatttcatattgtcctaccaattatgaatgtgttattcctggcaggcaggtctctttaaaattgcatatgcttagttctttgccagggagaagagagaaaatcattgtcagcctctttatactcagctggggccaggtgttgttcattaacatgtaaatagtgcaattactgccaattaagattttttaaaacattaaaatctgtgggaacacagttatatcacctataaaatttaaaatacatgtatacatcttagtgctttagattcctacaaggcatgtactataacttgtagtcttaattacccaatgcttcaagttgtcatttatttgcacaatgccacatatgaggttcaaatgaaatgtaaaagtacattggctgagtttatgattgtagccaaatattgagaatttattatggattatattgattgtcagattattttgatttgtcctttaaaaaatttttctatttcttactccgtgtaaggaactgggttaagtgcaatgtattcaatggtgaatgaggcagacatggtctctgcccccatgaatcttacagtgtagttgggcttcacaaataaacaagcaatacacatacaaataagcatacaactaggtaagtattgttataggtactgttgtataaaatgagagggtgccattagaattcatgatggagcaggatgagtacagtttggatagagaggatagaaagctctctatgaatatgcagcatttccactgaagcttgagggataaacaggtgatatccaggtgaagagagtggagaagagcataccagcaagagataagagcgcttagaaaggccttgaagcaagaaacagcttgctgtcttcaagtaattgacagaaagaatacatgccaacttgaaggtagtggttgcctccagggagcaaaggagcagaacagaatttagaagcagtaagaagggggtttcaagagcaactgtaatactttaattctttaataaaaaatataagcaaatataatgaaaggttaacattcattattatcccttggtggatttatggatgtttgttatattactcttggtacttttctatgtgattaaaatgtttgatcactgggaaaaaatgtgaatgagaggtgagaaagtagattttaaaatttgtttacagtagtatgaactgggctttgttataagaaagagttaaaaactgttaatgtatttttgcctctttaaaaatatttctttgaattttacttgggggtattcaaacccttagccactactgatatctattagcaaactctattatctattgatgacatagatactactatgttatcaatagaaataacttggcaacaagcacatccttctgctgcaccctactttgcagtacaatagtttgtttttgcactaatagagctacttgaggctgaagcagtggggcttagaatgaaacctttattggggggtggggccaagatggccaactaaaaccagcagcaatcagaggctcccatcgaaaagaaccataacagcatgtggatcctgcaatggcaaccgaggtatccaggttctgtcatcagaactgactaggcggctggtgtgacccacagagaggaaagaagaacagtgtggtgtggtggcccatgtgggagccatatggggcaagggagcccccagccccccagccaagggaggcagttggtgccccccaaggtcagagatcccagaggaaggagcaggcacccatctttgctgttctccagcctcctcgagtgacatctccaggtacgggagtgaaccagatgaatagggcctgaaatgaacccccagcaaactgcggcagccctaaagaagagggacctgaccattgaaagaaaaacaaacagaaagcaacaacaagagcaccaaaaaaagtccccacaaaaaccctatagaagggccagcagcctcaaagatggatactagacaaactcatgaagatgagaaagaatcaacaacaaaaaaaagttgaaaacccaaaaggccagagtgcctcttctccaaatgctcacaatgcctatccagcaaggggacagaactggaaggaggatgagatgggcaaattgacagaagtaggcttcagaaggtcagtaataacaaactccactgagctaaaggagcatgttctaacccaatgcaaagaagctaagaaccttgatgttaagggaagccagagaagaaggtcaggtcaccttcaaagagaagcctatcagactaacaatgaacctctcagcagaaaccatacaagccagaagagagtgggggccaatatgcagcattcttaaagaaaagaattttcaacccagaatttcatatccagccagactaaccttaataagtggaggagaaataaaatcctctccagaaaagcaaatactgagggattttgtcaccaccaggcctgccttgcaagagctcctgaaggaagtattaaatatgaaaaggaaaaactggtaccagcaactgcaaaaacacaccaaaatataaaggccaatgacacgatgaagaaactgcatcaactagtgtgcaaaataaccagaaagcatcatgatgacagaatcaaattcacacataacaatattaaccttaaatgtaaatgggctaaatgccccaattaaaagacacagactggcaaattggataaagagtcaagacccatcagtgtgctgtattcaggagacccatcttacatgcaaagacacacatagactcaaaataaagggatggaggaagatttggaaatggaaagcaaaaaagagcagggattgcaatcctagtctctgacaagacagactttaaaccaacaaagatcaaaaaacacaaagaagggcattacgtaatggaaaagggatcaattcaacaacaagagctaactatcttaaatgtatatacacccaatacaccaagattcataaaacaagttcttagagacctacaaagagacttagactcccacacaataataatgggaaaatttaacaccccactgtcaatattatacagatcaatgagacataaaattaacaaggatattctggacttgaactcaactctggatcaagtggacctaatagacatctacagaactctccaccccaaatcaacagaatatatattcttctcagtgctacatggcacttattccaaaatcaaccacataattagaagtaaaacactcctcagcaactgcaaaagaactgaaatcataacagtctctcagacaacagcacaatcaaattagaactcaggattaagaaactcactgaaaaccacacaactacgtggaaattgaacaatgtgctcctgaatgactactgggtaaataatgaaattaaggcaaaaatcaagaagttctgtgaaacctattagaacaaagagacaatgtactagaatccctgggacacagctaaagcagtgttaagagggaaatttatagcactaaatgcccacataagaaagaaagaaaaatctcaagttgacaccctgacatcacaattaaaagagccacagaagcaagaggaaacaaatccaaaaactaccaacagacaggaaataatgaagatcagagcagaactgaagaagatagaggcatgaaaaatccttcaaagaaaattaataaatccaggagctgtttttttgaaaaaattaacaaaatagatggaccactaactagactaataaagaagaaaagagagaagaatcaaatagacacaataaaaaatgataaaggggatatcaccacagaccccacagaaatgaaaactatcataatactataaacagctccatgcaaataagctagaaaatttataagaaatgaataaattcctgaacacatacaccatcccaagactaaaccaggaagaagttgaatccctgaatagactaataaaaagttctgaaattgaagcagtaattagtagcctaccaaccacaaaaagcccaggaccagacagatttacagccaaattgaaccagagatacaaagaggagctagtaccattccttctgaaactatttcaagtaattgaaaaggagggactccaccctaactcattttatgaggccagcatcatcctgataccaaaacctggtaaagacacaacaaaaaaagaaaacttcagaccaatatcactgatgaacatggatgcaaaaaatttcaataaaataccagcaaactgaatccagcaggacatcaaaatgcttatctagcatgataaaattggtttcatccctgggatgcaaggctggttcaacacatgtaaatcaacaaatgtaattcatcacataaacagaagcaatgacaaaaaccacacaatcatctcaatagatgcagaaaaagcctttggtaaaattcaacatcccttcacgttaaaaactcacaataaactagatatcaatggaacatatctcaaaattataagagctacttatgacaaacccacagccaatatcatactgaatgggaaaagctggaagcattccctttgaaaactgacacaagacaagaatgccctctctcaccactcctattcaacatagtattgtaagttctggcagggtaatcaggcaaaagaaagaaataaaggatatttaaataggaagagaggaagttaaattgtctctgtttgcagacagtgtgatcctatatttagaaaaccccattgtctcagccccaaaacaagcagagagtcaaatcatgaataaactcccattcacaattgctacaaagagaataaaatacctaggaatacagctagctaggaatgtgaaggacctcttcaaggagaaccacagaccactactcaaggaaataagagaggacacaaacaagtggaaaaatattccatgctcatggatagaaagaatcaatatcatgaaaatggccatactgcccaaagtaatttagagattcagtgctattcccattaaactaccattgacattcttcacagaattagaaaaaaaaactactttaaatttcatatggaacaaaaaaagagcccatatagccaagacaatcctaagcaaaaagaataaagctgggggcatcatgctacctgactttaaactatactacaaagctacagtaaccaaaacagcatggtactggtaccaaaacagatatatagaccagtgaaagagaacagagacctgagaaataagaccacatatatgcaacaatctgatctttgacaaacctgaaaaagaaaaagcaatggggtaaggattccctatttaataaatggtgttgggaaaactagctagccatacacagaaaactgaaactggaccccttccttataccttatacaaaaattaattcaaagtggattaaagacttaaatgtaaaatctaaaaccataaaaactctagaagaaaacctaggcaataccattcaggatacaggcatgggcaaagacttcatgactaaaacaccaaaagcaattgcaacaaaaacccaaattgacaaatgggatctaattaaactgaagaacttctgcacagcaaaagaaactatcattagagtgaacaggcaacctacagaataggagaatatttttgcaatctacccatctgacaaagggttaatatccagaatctacaaggaacataaagaaatttataagaaaaaaaacaaccccatcaaaaagagggtgaaggatatgaacagacacttctcaaaagaagacatttatgcagccaacaaacatatgaaaaaaagctcatcatcactggtcattagagaaatgcaaatcaaaaccacaaagagataccatctcacaccagtagaatggcgatcattaaaaagtcaggaaacaacagatgctggagaggatatggagaaataggaatgcttgtacactgttggtgggagtgttaattagttcaaccattgtggaatacagggtggcaattcctcaaggatctagtaccagaaataccatttgacccagcaatcccattatgggttatatactacaaggattataaatcattctactataaagacacatgcacatgtatgtttcttgcagcactgttcacaatagcaaagacttggaaccaagccaaatgcccattgatgatagactggataaagaaaatgtggcacatatatggaatactatgcagctgtaaaaaggaatgagatcatgtcctttgcagggacatggatgaaactggaagccatcatcctcagcaaactaacacaggaacagaaaaccaaacactgcatgttctcactcataagtgggggttgaacaatgagaccacatggacacagggagggaaacaacacacacctgggccagttggagggtggggacaaagggagggagagcattaggacaatatctaatgcatgcttggcttaaaacctaagtgacaggttgataggtgcagaaaaccaccaaggcacacatatacctatgtaacaaacctgcacattctgtatttgtatcccagaagttaaagtaaaattaaaaaaaaaaaaaacctttacggctaactttatcaagtaaccaaatccctttattaagaacaactaataagcccatccttcatcaaagactcttattacctagctaactctgttataatgttaacactttaattatgtttccagggaaaaataagtcatgccactgtctctgaaaaatgcaaccaagttaataggggcctttgaaaggaagttcttgaattccagtattttaatccttcagcctcatcatagtaattttatatctggatggacaagtctctaggaatacctagtgactaaaaagccagtggaagaaggtatcctaaaatccatcttgggcagccccaaggaactatgtgctatggaaaacccctcaaagaataatcaactgcaggttgcccttgtttatctacttgcctgattgaagagagaaagccagacccatccagttcagtcacatcagcacgaacttcagttcaacagacatttgactcattactatatacagggcacttcatgggctacaaaattgagtaagctacaacccaaaaatgccaggagtttaaagtctacttttggacacggaacaaatacaaatctaatccatttcagagttggaagaagcgtggaagtgagctcatggtgaagtggctagggaaagagaaatgactatatctctttcaactcctagataaattgattcaaattagactgatgttccttattcctaaccatgacattctcatgaaagagaagctagtagaaatctagaaatactcattgtaatcaaatggttgctttaaacaccaaggtaaaattcagttatatataattatcattcacaatctaggaaaatgtctctttttttcataaagaggccaattataacaataaatgtcaaattccttaagtgtaaatcttatagttgaggcttaagtaactaagactgtatctggcattccagaaaagataggttgatattttatataaaattattattctgcctgatataccatatcttctatatttagtataataatgagctcttcccagcagagaacaatatttttaaaatctgatgtttgatgccagtcccaagatagtcgtactcaaggtacttgatttagaaagaagaaaacagcaagattttcctgtgtttttaagtcgagaagtcccgattttataaattgacttggatagagaagtacataaaatataatgcaaaggtcataagggtctgttatctgttccaaaatagtgatccctggtggaaaagcaatgtagtgcatatggccatggctgcaaaatgaaaatgtgttctaagcaggacctgctgaactgaataagcacagatgtacttcaaattaatatttaatctgataccaaatcacttaaaggagttagggatatgaattcctcataagaaataacttccttctcacagagaacaattatggtactgcaaaggtaacacaaataagattgtcatattttcgttagatttaaagagtaaatctggaaatgaaagtattttgctggctctttttttgaattttcttaatattatttcttgtaaaaagaaaatcctctttgaatgtgatggcatggatcaaaatgaaagctaataaagtcagtttgattgagagactatctcagcccttgagagtagatgagagtgatttttaattgacatcattagagtattattagaataaaatagaaccaagtaaaatagaaccaagtaacccttactaatctttaaaaggaaagtgcctataatcaagttacaattctgaaaagcaattctgttgctttttcaggccattttcagaagcagatcctcaaaataagctggagtccagagctgtctcatgcctttcattttaaacccacttttgttccacattttggcctgtcaaaaatgttattatcacattacatactgaatactcagaaaccaccgcctaaatttaaaaaaaaaaagaaactgccaccttaggttaaagtgacatttcatctcttagggtggtttttttctgaattaaaagaggtgactgaacttactacttcaatagaaagcaaagacacttcacaagtatagtaggcactaactggaacatagtatgacaaagaaaaacaggctatattacacttaccatcatatttaccactaaaatattagctctctttgcaagatagttagcttttgtatgatcaaaatgccacatggacattgtattgaggtaactatttttagataatgggttagtcttatacattgcagcaattatgcaggaattataagctatctacatcttttcatttgaggagataaaggacatcccctcccagtcatgcattcaacaagtattgaaactacttcttatttatgtattcagaatatatttgagcacctacaacatgctaggcttgaagtattgaaactactaggcttcaagtattgaaactactacttatttatgtattcagtatatatttgagcacttaacaacatgctaggcactgtgccagatgctagagatgtaacattgaacaatgctgccctatatcccagtgggagaaagaagcaaaaagtcaaaacagaaatatgtagatatggtaataccattcatttcagagaataagggaggtgattgtggaaactacgttaacagtagggaaagctgaaaaaaatccttccttaggaggtgacaattgaggtgggacctgaagtatgagaagagaaaatcaatcattcaatggatggtgagggcaggaagaccctttccggcatatgcaaagggcctgtggtggaagaagatgaccccatctaagaaatgcaaccagacccgtgtgtcaaaaatgtgatagactaaggggagaatagctcaacagaggaaactctaagctaaacagcaaccaggtcacagaaggtcttggaggccattacaatgagcttaaatgctttcctaagtacaataggaagccactgaaggagtttaagcaaggggtgggatgttcagttttgtttttttaaagtttattctagggctgactattgtacagtaaataggttggcggggggattggaagtggggaaaccaggaagctgactattgtacttattcagatgagagatgacggtggaaacagagagaggtggatagagagaagatatatttctgaaggaaaccaatagaatgtggtgacgtattgcatgtggaagttaaggcacaaggagaaatcggtatgattctattatcttgtttgagcaactgagtaccttgtggtgtcacttaggctagatgagcaaaagggcatagtgaaaataggggaatcaagaattatgttttaggtatgttaaatacttgtctatgagatatccaaactgttattgaattttggctggatacacaaacctaggcttgaggagcacatagttagcctgctactgactgggaggagtcagcaaacagcgacatttagagtcattacagttctttttagttcccgaatgcttattcctttggattcaggcattgatggctctactcaaaatatcagcactatctcaatggtggttccacatattagacattgtttcctgagactgacccgagacaatgtgccagagggtgaatgagttccgttgggatacagaaggtttttatttaaaaggtctggattatgcagttctattaagaaggcagatttgggtgggatttcacagtccagagggcaaggggccacttgggagaagaggaggaagatagaaagggaaagaggtttttaaaaagagatggaaatagtgctgtaaaagaaactgagtcatttcacaactttggagagagccgggtctgctactagatatttttctgtaaatttttgagttcctttttattaataaaaatgaaaaatttagtaagcacttactgtatgccaagcactgatctaagtacattacataactaactcatgtagttctctgcagaaagctatgaaatatgcgtttggccacttttgcagatgaagaagaagacacagagaagttccgtaatttctaaattcaccaaggcatttggtggtgtgctaagatttgaatcttggcagtcagtttccagaacccatggtcttaaccattacactatatatttcagtttcagtataatataacatgtgattgtaaatgtcttttttgtctttctaataagcaggtcttttaccaagactaccagagaaatcttagttttcattattttttgtcctgtaagttctacatgttttatggcctggagaataattatgatgatggttgtataatattaagatacctgcttccagtctacatattctgtgattttgttctattttatttcatttttattttctcatatttcttagccctttgccccttaaaaataattaccagagtagtatttactgatcatcatagaaaccactacccaattcttcaaccctattatattgatcataatttattgatgaggtctgacatctcacactctttatccagacttcctcccatgaggaaaagactataaaattattttcctgcctggcacatttaattccagaaacttgcatctaatactattgtggtgaacaactccagctgctgttccaggttcagagtcattttactccatagaaaaaaagtatgttaattgactaatctatatattgtaatatttgtttctttaatgatagggttttaatttaacttagccatatgttagggcccatgtttagaaattagtctattttcaaactaacattcaagaactgcccaagtatacagagaagtttaattgactgaaatgtgtaaaacaaagcaaaattattaagttaaaaataatgatattgtctagttattttttaacttcgaaatacttaaaactccttgaaactttgctgtaatcaactgatttttaatttactaatttgaaagtgttttgctttattaaaatgttttttttcatcctagggatactttttttctcatggctaggtttcatctgtcattgtgccttatgggcttgccctttgccttttgcaaatggtctatttcccttctaacaaatatgcttcgaattttcataaaagatatgtaacaatgttagctttttttctgggtgagaaatggcataacacaactctaaagagtttattactgtcaaagtctgtcccttggaattataggtagatgtttgtgaaaagaactagaaaattctctctcttcttataatcttcaagaatacttcggatgaatgtgagttcagaaatggtcattcctgtgacattggcatgtttaaggcactgaccaactgataggcacaatctaaaaacaaaacgacctatgcctactggaaatctgtgtaggctgtatagactctggaaatttcactacagaacacctagcacatgatttttattcagcatttggtaggaaaagaaaatgaatttatttttcaaataaaaaatgtatcaaggaaagttctggggaaaggaaggagtatgggattgggggtagaagtggaaatttgattacttgagttattgaaatgattcagaatggcaaacttctagaagtactcccaatttccctctgagataattcagtcctcccaaagataggtcgggtgtttcccagagagaggaaatattgtactatctgaaagaaataaaatccttccctggatccatccttcataggaaggttaacatctccctgaaggctttctgtcaactctggagacacagtgtggtgtgtctggggagcatattttacacacatgcacacacacacacacgcaattatgcacacacaagccattaaataagacagtgaaataataactctacttattgccagcttcctactgaagtatgcctatcccattgctcccataatggagaaaattaatatatcctgtcagggtcacataatatgaatagtgaaattctgtgaagtgactgcatgtagaagagtcaggaaatccactttgatctacatttttgatgtttgataattgcacttattatcaggtcctttctgctctttttctttgacatgagatccattatcagtgacagcatgagcgtgagtatgtgtttgatttaaaaaactacttaagatgaggtaatggaaaagaagcgttttttgtccatgcatattaaaagaatgggagacaattaaatctcattatacagtggctggcttgaattgtttatcttttatgtatggcattgtttgggcacctcatggggtaacttttttcaaaagaaattatttcctagtgatatattttgtatatatgtagactgttatcatttgctttgatgctttcattctatgagaaagcattgagagaagagataaagaaatgatggtcacaaaaaataggacaggtcatgtagccaaccgctgctttttcagaaatcgttataaatagaatgcatagtcatatgtgaataggactaaaaacagaacataaattcatatttataccaaggcagataattggtaaatttattaactaggattctttctgtatctgttaatttattttaaataacacaagttaccttgatgcaagtaattattggcaattaatatgtgataaggtatttgaacttttctgcttgcctaaattttacaacaagggctcaggctaatttagcactttaacgtgtcaccttgcacattaacaaattagtattcttcacagtagaagcctaagtaaaatgctaacccattcatttactattttttttatttctattgtggacattacctacttttggtctttggctgtcaatattatacatataaataagtattctataaatcagtattatataaataatacatggctaaatggtaaaattataaaactctttcagccaaaattaaatgctactcccatatttttgcttacaaatttctcttctttgctgaataatagagaaaaataaacttgtctttactcatccaagttaacttggatttaatttggagcagctaaaaaaattaatagtctttgatgttcctcttttccattaactttacttttttcagatatgttctcaataaaaagttattggagaagtagtactcctcacggctcttggagaaaatgagagtgtatttggaaatagtttatggagtagcttttgtagcctctgactttctctgagtgacttcgtacccaaaaacagtcaggtggaaccattttgtaaagtataaagcgccatacaaatgtcatcaaatgttagaaaaagtaggagaatatggtaagatatgacaaagtacaaccacatacattccaaatgaaagccttagcctaatttgagctacatttgtgctacctttgaattgctagtttatttgttagtgcttaatatggtttgactctgtgtccccacccaaatctcatagctcccataattcccatgtgttgtgggaggaacctggtgggagatgactgaattatgggggcaggtctttcctgtgctgttctcatgatagtgcatgggtctcatgagatctgatggttttaaaaaggggagttgccctgcacaagctctctttttgcctactgccatccatgtaagatgtgacttgctcctccttgccttctgctatgattataaggccttctcagccatgtggaactgtaagtccaataaaccactttgttttgtaaattgcccagtcttgggtatgactttatcagcagcatgaaaatggactaatacagtaaattggtaccagtagaatgaggcgctactgaaaaaaatacctaaaaatgtggaagcgactttggaactgagtaacaggcagaggttggaacagtttggagggatccaaagaagaaaggaaaatgtgggaaagtttggaactccctagagacttgttgactggctttccccaaaatgctaataatgatatggacaatgaaatccaggctgaggtggtctcagatggagatgaggaatttggtgggaactggatctaagatgactctcgttatgttttagcaaagagactggcagcattttgcccctgccctagagatctgtggaactttgaacttgagagagatgacttagggtatctggtggatgaaatttctaagcagcaagagtgacttggtgctgttaaaggcattcagtttttaaaaggaaacagagcatgaaagttcagaaaatttgcagcctgacaatgcaatagaaaagaaaatcccattttctgaggagaaattcaagctggctgcagaaatttgcataagtaatgaggagacaaatgttaatccccaagacaatggagaaaatgtctccagggcatgtcagaggtcttcacagcagcccctcccatcacaggctgggaggtctaggaggaaaatatggtttcctgggccaggtccaggacccccctgctgtgtgcagcctaggaacttggtgccctgcatcccagccactgcagccatgactaaaaggggccaaggtacaactcgggctgtggattcagaaggtgcaatccccaagtcttggcagcttacacatggtattgaccctgcaagtgcagagaagtcaagaattgaggtttgggaacctccacctagatttcagaagatgtatggaaatgcctggatatccaggtagaagcttgctataggggagaggccctcatggagaacctctgctagggcagtgtggaagggaaatgtgggacaaagccccaacccagagtccctgctggggcaccaccaagtggagctgtaaggaaagggccactgtcctccataccccagaattgtagatccactgacagcttgtatcatgcacctggaaaagccacagacatgcaacacaagcccatgaaagcagccatgaggggggctataccctgtagagccacagaggcggagctgcccaagactatggaagcccacctcttatatcagtgtgacttggacatgagacatggagtcaaaggagatcattttggagcattaagatttgactgctttgctggatttcaaacttgcatggggcctgtagcccctttgttttggccagtttctcccatttggaatagctgtatttacccaatgcctgtatccccattgtatctacaaattaactaactggattttgattttacaggctcataggaggaagggacttgcctcatcttagatgagactttggactgtggacttttgagttaatgtcgaaatgcgttgagactttaggggactgttgggaaggcatgattggttttgaaatgtgaaaatacgagatttgggagaggccaggtacagaatggtatggtttggctctgtgtccccacccaaatctcatattgtagctcccataatttccgtgtgttataggaggggaccagtgggagatgattgaattatggggatgggtctttcctgctagtttatgttagtgcttgatatggtttggctctgtgttctacccaaatctcatcatatagctctcataattcccacgtgttgtgggaaggacctggggggagattattgaattataggggcaggtcttttctgggctgctgtcatgatagtgaatgggtctcatgagatctaatggtttttaaaacgggagttgccccgcacaagctccctttttgcctgctgccatccacataagatgtgacttgctcctccttgccttccaccatgattttgaggcctccccagccatgtggaactgtaagtccaataagccgctttcttttgtaaattgtccagtctcaggtatgtctttatcagcagtgtgaaaacagactaatacagtgctgaagcacatatactatattatagaatctatctcatttcattgttctctagcattcttaagcattgtaaataatttagcacacctttagggaactggaggagttaaaatatttttattggaaatttgtaaagataatattaagagcttatattttagtctaatcttagaaaataatagaaaagcttacaccattgtcagaatacctttctccccaaacaggcaaatttcaatgctgttatctgaatatgctctctagggacaagagataacctgttgagaatttgtgactttccaacatctttttgatggaggtggattctgataccataagcaatggatatcacctacatcaagagtattgctaaaggcagggcctgaaatcaaaggattaaagaaaaaggaaaggggcccaaatcaaacttatttcaaattctgtgtatagccagtaacatccaggcaagatttacaagagggtaaactttcccaaagtttgtaaaatcatttaagtgagttaattccatatggtgaaagtatacacaaaatgtgtctggagatacattgttattaataatacactttccagatattttcacagaatattaacttcaatgactgagcagtactatagctgatgacctcaaatcagttccaattaatatgcctctgcttttgtacataaaaggttaaaaattagcactgtaatgaaatgttgcataatactttgagagttgtgttgagtgggcaataatattttttatttaaatgataaaacagggtattgaatgaaattactaatgtttccatgaatactgaaagtataagactcccgtgagtacagaactgttaacctcttttgaattgagattttgatgtcatatatttatattgagttacattattttttaaagaatagtacatatttttattattacatattaaagaatgagtacatatttttactgagttgttaggtcatgttcattcctttgctttgtctttctggcttgctttttgccttatcatggataggaaggggaagggtaagcattcagaaattactagctttgtccatataaacagttgctcagtaaaaaactaacaaattgttgaaccataataatattgttttccatattaaaactcaggcatgggaacagcaagactccattggtttttcaaacctgctttgtgacaattgcatatatatggttctattaagccctttcacttggatacagtttatttccagaaatgttcaatttgtggatagtgttcatttaagaatttcatcagtgtttgaaaaaataatttaaatgttgactgatggaccactaaatcctttgaagttgaccacgcagtcctcctgcatgccagaaacctaaattcgtgtgagtaggtgttagagggagtagtctatatgaaagggagactctttgttttgtgaaacgatttactacaagtttattttaaatcatgtagtcaaaatataatttaacagagcaccagttatttatataataatacatttgccagatcacatatgatggatatgcaagagatatatctgaaaactgaatggcagaagcaaatacctatttattcgtgtcttcctgtacaaatatcaactgcttcccaatttgaaaaagcatggttaagatagagaatatagtgcagtattatcttcctgcttccaaataagataatatcatagtgaatatatattatgctttatagttaacattcttacgatgtatattttctagctttacttggaaattctccaaaaaattgtatatatgtagattattgttatattcaggagcaacattgacctattatactaatagtaaatacatgggccctatataaacgctacttgaggcaaatgtattcaccatatgaagctactataagatgctccaaatattcatggattattcaaaattagagtaaacactattgagcaaagtacaatatttgtgaataatttgaaatgtcaccattttgaatatttattacacagcatgacaagatagaatcattgtccaggagactggctgacaaatcgggtctcatgaggaagtattatcctttccattatctgttacttcaagtccattctgtttagcacttgttacagcatctaaagtgatttgacctctaaggtctgccttaccttaaccaaattgagactgatgtataaaaccagtcagtcaactgattcatttacaatataaaatataacttcaaagcaagtcaaaatattcttgtcagtggtcaaagtatttggtcaaagtattgtttcctgttgggaagctacatgggaaaccaaatgataaccagaaggttcctttacaaggatggatatgagagaaaaaagaagttagttggaagaccaaactctgagtagtccattatgggatatgcctggcccagcatcagatacttagattcctgaataaggtgacccgtttaactagacagcatgggtaaggataacaatgataaattctttctatgattctccttttctatgtcccatgtttctaatagcacattctttcttcccactactgtaactattaccatatcagcttaatcacatctggctgttcctaaaatacttgaccactcagttacagattattacttagaatgggctccttctacaactaatctcattcattacattttattcctaattttattctcaattaatggtctttacttttaaatttgggaggactttcatgtccatattgcctacaatagcctcaaaccattgctgtatccaacgcttcctcaataggtgactagccaaagaatagaaatatacattgccatgtaattgagattcttttgatggtatataacagaaatgtaaacaaaaaagtgagaaattcaatttattattagaatataggagtatctcagaacccaaggacagaaatcactataaggcctaattgagggactggactaggaattggaaagaaatcagtaactcccacaccctcaattttttcatgtattcctcttgtgtgtttgttttattctctctgcagatgaactctccttccctctgtatgtgaccagaaagggccatacttctgatcatgaatggacataatatctcaaattttaaaacctgactaactaatattctgtcccaactttaaaatcccaggagagatcatcttattagtaaaacttggatcaggggccagctgccagagtatttgactctcagaatattagaggaagaatcatataactgccacaggagccttatctctgtggatagtgggcagttttcagagaaagggaaggtgagctaagcaaatatctaaaaattggctgctgtatatgaagagactaatgagacttaggcatgatcatgaatgacttgtctttcctcactttttatttcaaatactgtgatttttcaccttagaatttccattctcttttttgttttctatttctctgatgagatttcctttctttctgtttactgtgggcctattttccttcatatcctgagcacagttatagtatctactttaaaaccctggtctgctaattccaatatctggttttcttggagttattctctataggttgtcttttctcttgagaatgagtcacatttttctgtttttcatattttaaataattttggactgtattttggacattgtgattgttattttgtggagactgtagattctgttctattattattctaaatagttttaatttttttctcttcatgtagaaggcaattaaattttttggactccaatgacaaattctgtttcttgagctgcagctcaaatctcagttgagtttcttcattctcagttgcagtcagcctcacacatgcatgattccaggtcagggagagatttgggcagagtttatatacagaatatggggtgcattctctctcttatcttttttgggggatgcccccttgactttccagtggttgtggttgcctaaactctgttccctatttttttatgtgagagatactgagagttttctgtcaagatttctgccaccctgtgctgcctcattgtttcctaccttctggtttaaaaaaataaaaaataaataaataaaaactggaaattaacccatgccttcccttcttccaagtgttgattccccaccataatctgcttcttttgttcactctccagttcctaaaggtcatcgatttttttattgaattttgtctagtgattatcacctgcagaaagatagattatgatagaagcttactaaactatacccttctcaccacttattcgacattacttcctgctctttatagtgagttctttttaaaaattattataacacatgcttatcataaaaataacgagtatgtgtataacacaatatatgctagattgttctaagcaatttttatataataactagatcatgaaataaatagtacagaattatgtaatgtacacttaaaagttctatttctcccactattctactctgagagatgagtattcttcctgatatttcttacacaagtcaaactttactatatatcatctttctgcaatatgcttttctcacactcacaatatatcataggtatctttccaaatcatcttaaatcttaaattatctaacataaatttgctactactagtacaactttcacacacatacacaaacttgcagactgagtacactcatatcatagagaaatttgcattatcatttttatgaacgaacttttctggttaggtagctttacccaactaattttcttttccttctccttcaggtggctaaaccataaccatgcccaatgtcagaatattgtcagactgcactctacaattaactgtttttccttatttaagtcaagtcaattaaatccatacaatcattgtgaaactaaaaatgaaataatgtatatgaaaaatacttcaaaaagtttaaactgttaaataaatgagtaatatcagtttgacctacattttttagtatctgctgtgtataagagtctcggaggttataaggatgaataggatgcaatatcggtcttcaaggtgatgacaatctagcttttaaaatgtagttaatgctatgacatagatttttttaaatgtgttatgggagtggcaatgggaggacaattgattctgacaaagagaatcagagatgtatgagagatgatgaggtgaattggtccatgaatgataaaaagaaatttcaggtatgagactgaaggaaggggatgtattccaagatgaaagaacagtgtatatgtaggcatgaaagtatttatttttctggtaataccaagtaagtcattttggttgaagcatagggtatggtatatatggtcatgggaggggggtaagagtcaaggattaaaagtagaatgagactatagagtgagtcacatttggatttataagggccttataggtgttgttccaagaaatttgcctacaatatgatagccagtgaattaaggatcttgcccagagaaatagcacagtgtatggtgtataagacaatgctagcttctgttacaaactaacctaaaattgtacaatggctcaaaaatagtagtttgtttctcattcacctaaaatgcaactggagaattcctgattagtaggctgttctcctgggcttgacttagggcacaggctctttccatccttgtagcgccactgtctttaacacatggcttgaaaagttgccatgtttgtctacatcaagctagaggaaaggaggagagcaaagatcatgagtggaagattttattgaccagacctggaaatggtactcaacacttctattttctaaactcagtcatatgtatacagttatctgcaagaaagcctgggaaatgaggtctaacttcttccttggaagaagaggagaggaatgtagtgaacaacttggtggtctctgtcacaaatagtcagatttagtttttagaaagcccaccctggttgcagtgtcagtgatggattgtaggaggagatactaaaagcaggagagcagataagaggctgttttcatagtgcaagtgagagatagtcaggtcctaaaggcaatgcttaaggagccacttgcatcagggataagacagggatacattttggagaccagatttgatgactgagaattcaggggccagagtttgttgacttgagcaataggttgatagcctagatgaatggtgattactctatatcatgataataatgctcatccaaaaaaaatgattgcttacttagactggtaataattgagtgtttgatagatcagagccctttgtcaagagctataggaaaataaagtagagtattttatatggccctttccctcaaggagtttttaatctatctgaggagagagaatacacccaaatgacaacttgacaacttttatgtatatcagtaaatgtgagttaattcaacacaaactgaatccgagtgctagaggggttggtggaagagttgtgtttaagaatgcatgggatcattaggatgtaagtttggaagttggattttattctttcatttaacaaacatgtattaagtgtatggtgtgcttagataactgtactgctggttcataaaaaggctcaagtaatatttgttgaataaaatattagttatttaatgagacaaacaaaaaataacccttacttttgagggatttattagaaataagtaatatgggacagtaaggttaacataaaggtaaacaaccagtacaataatgtttaacaagtggtatgatagaatggtccggttggggcacaaaggaaggaatgttcaagaaaaatctttgttaagcatgaaactcttgagcttgtcttggaataacagtacaagtgaccacacaaactaaagatgaaagagagagaagaaaggtctttccaatgcagcagcaaagatgaaggtatgacaaggaaagtgggttggcaagagatgaagcctagtgttccctgaacctagtgttccctgaatttagggaccaagtcgtgttaatatctgtacccttgtgcatagtacttgtcccttttgagatgctcagaaaataatggattctattcctatatgccttcttgtagtcctggcgagtgtatctagtacacttctcttcaacttcagacatctaactaattaacagaggtagtgaaataatgatttttccatcagtgactgaaggctctgcttgtccctgctggtgacctcactttacattctcctgaggctacaaagtcatttgcaggtatatttggttgttttaaatcacagttgcaaaccatcactgatataagccatctaaagtcccaatttctgctcaaagagagatgcctaactgaaataatagtatcaccaaacaccatcttgaattcaaaatcagattgaggcaacaaataaagttttatgtgatgtgaatcaccaatggtatgaatttctcttactctagcagaactatatttcttaaaagctaacaaccatattttcttagtgaaatttactgtttgaagtgtataagcacgctttggtccttgaagggttgtaattttaaccggagatatttcagaataagataataagttgagaaatgagtgcttgggcaaggagtttgaaaatgcaattttatttcattggcatttttctgtctagcctcatatgtgtttttatgcactaaataagtatattgtaatttagaccttgtggtttaattttccatgagcctaatccctaatctatactgggaagaatgatcctcttaaaatggggggtatctaaaacctcttttgtgttttcctgctaataaataacttatattaaaataaaagtatgggattgtgaatatttgaggtcagacagacttaaggttagttcccaatttgccacttactaactgggtggccttaagcaagttacttaaatgttctgagccttgctttcttcatctgtaaaatgagaatagtatcaactaccccttgcaggatatttgtgagaattagagattatatggtgggaattaccatgtatgaggtgtttaaagagtgggaattgctactgccacaaatattgttgttggcatctttcagttagagtcaacttccaggggaaaaagtgtatttggaactgccctctgcatataacagttttaaaacttttcccatttgcacaaagatcctatatgtgacctcaaagtatataatgggtaaaagtaaaggtgagatactcaaagcttcaggccccatcctagtccctaagacgtgctcatgaaatacaatttgaaaaccattccctcagtggcatacgtttacaagtgctaggggaacttaaaacatgacattaaaagaaaagcaagatttctaagaaagcactgcatagttcctggtagatccttgtatgatctaaatgcttattctattaaatgtatggtaaaaagcactgcaatcgggacttataagaaaatcgtgcactatgcctactgaactacccctctgtaaagaagcatgagaaatgaatcgtctttgaggagggcagtataaacttttcatgatttcctaacttttctgcagtattgtcaaagaggtaggctataacctatgcccacaattattgaatgacagccttccctcaagacactttactgccatcagaaacttactgtaaaatactagttgttagaataagactctctacagctatattccagaaaccttttaataagtctgttgattttcattatcctctacgatccctagtatctccaatgtgaatggcacactctgaaatggagcactcttgtacagtgtgtaatcagcatacattataccatgaccctgctgatatccatattttttaataaagatgaattgtttggttaaatataaatggcagctaattaaaaatataattttcacttaaatttttatacagatgcttcagaaatcaagttcaaataaagcagtaaaccatacagattctacaatttcaagggcttctctgtaggcagataaaatagcagaaattcagctgtcaacaaaattataggcagattaggtgctatctacgaattaaaatgtaaaatttgtaaataatcttccttgaggtgattgagttgcatatgatttactcacattgacagatgaaattccttcttttactttttatggcttaaaatatactagaaatataaatgcattcccttgactattaagctgacatacctttagaatattgaaaaaccaaagcaacattattttatttcagtcctcaaaagcaaatttttgcactaaaattccactcattgtgttgtagagctttgctccttagttcagctaaaacccagattcttgtcacatgaccaggaaagtttaggcatgcggacacattgaagggtgaggggagcaggactttactgagcgaaaaggataaaaaggaagaaaactcagcaaagtgagatggagtcctgctaacaagccctctgcctcacagattgaatcccaggtcaccacataaaaactgaggagtccaggctcctcccacctgcaaacaacgcaaacttcccggggctccacctcgtcctcccagtgcgcaggccagttgcagattctccagggaccccgttttatctgcctaggcatttaactgtccctactggaacaaaagtagtttgcaatttaagagaacaattaaatatcctggtagtgaactctgtttcctgaaacgaatccactggataatgaaaaccaagacagtacaagaggggtcagcaaactatggcctgtgggccaaatctggcctatcgactgtttttgaaaatcaagttttattggaaaatagctgtgttcattcatttacacattgtctgtggctgctttggtgctaaactggtagagttgaatactagccacagagactatatgacctgcaaagcctaaagtatttactgtccagtccttcacagaaaaggtttgctgacctttgcaatattaaattatttgaaatggcaaataaaatattatatatgtttgtgtgagcaaatttatcaatacaaggaaggatattccacactttaaatgttaattatcatcaggaaaggtattggcaattaaatagaatacttctttcttccttgttgcacaattctactgcacctaaactcttccagtcactgcacatcaaaatacataaaatggaattgaataaaattcagagaatgaaaaatgaatttatactagactgaataatggaagagactcttacatttggggaaaatgatgagtggtgactttaccaattcttcaaagtcaaaaaggccaatggtaagctgagtactaacttttcagtagaacccttgaatacttgacaaagtactccaaagacaaaactcagggctataaggaccataagtgaaacaacagtttgtcagaagggactcattccttcctgttaagtttatataactacattgaatacaatcagaattcagacataggattactaagtggcgtttttttcaaaaaaggaatactaacactgatctcaagctaacagaaggtggcattgtgaccttcagaggttaagagcagtaagcagaaagttagtattagtatacaggagttttatttaattttattttacttatttttaaataattccaacttttattttagattcaggagtttaatgtcaggaatactgggaggaaacatgagaaggaggatgactgcttagaattaatttgcagaaccctttcttaaagcaatattttaagcggaaacccaagatacaaaaaccaaaaataaatgaagatgttgatgaagctagagtggatgagtgttaaagttctgcttgcttggaattaaaaaaaataaaataataaaactaaatttaaaagttctgcttgcttggatccctctcttctttatgtctgtctcctctgtgaagaagagctctgcattttcaattagcagactatcactgaaagtgattcaggaaggctactcacaaaaaaggaatatttgtgtgtccagcccatctaatttccaacatgtccagacaagtttattatgcttttttgctatctcccacttcttttggcctttattttcctgttatgaaatatttatgacatactgaaaatgttatttaatatttactcataaaattttgtaaaactttaaactttgcacataaacagataaatatttttggtatgcttttcaatcgatattcatcgaaaaggtttattacttttgtagatacctttcattgttttcattcttacttgtcttaaagtctaaaattaaatcagtatctctacccttttcctaaacaacagatggaaattaaattgttttaattttgatcattatcccttcatttacatgtaattatcatccagtattctgattatacttcttcttaacaccccaaaattatttattataatattttccacattcaatgcttatttagatttacccacatgtttaccacttacattaccattttttcttgcagctcatgcctttcttctgggttcagttttatgcttcctgaagtacatcctctcataattctttcagcaagggtctgtagtggtaaagtctccttctttgtaggaagttgtcttcattttaccctcagtcttgactaagaaattctctagataaggaatgcaatactgacagttgttttctctaagcattttgaaaatattacttcatgaactaacagatttattcctggtacaagtaacatactatccaacaataatgtcttcaacaataaagatgtacacagtcatagctcagtaaatgctggagattggttccaggaccccttcatatatcaaaattcttgcatacacaattcccacagtaggccccacagaactagcacataccaaaagttggcatcccatgaatactgtattttctatctgtgttttaaaaatcagcatgtaagtggacctgcagggttccaacccgtgttgttcaagagtcacctgtactttctaccataacaagcagttcagagctaggcagtactagggttggttaattgagcagctcaatataccacaaatctgagtcagcttctctgtgacacttttggcttttcttttatagttgttaaataacagccagctgcaaacatcatgtcctcacgatgataatgtccaaaggctgaaaggaagagccaagttctccttgcctatctctctctcgctatcagacaagataatcttttccagaaaccttttttcagacttcctctcagccagaattgggtggcatgctcacccactaatatagtcactggcaaagaagaatgaaatattatgacttgcttaaaccagtaatggagtttggagtggggcacatgtttcatacctgaacaatgtaagaattctgttagcaatgcaaaagaggttaatggctgctaggtaagcaaacaacagttttccatacttttttttttttttttttttgacggagtcttgctctgtcgcccaggctggagtgcagtggcatgatctcggctcactgcagcctccgcctcccgggttcaagcaattctcctgcctcagcctcctgagtagctgggattacaggtgcacgccaccacacctggctaacttgtatttttagtagagacggggtttatggtgccattaagtaatctgttgttattctaactaattatagcttcattgtagctaatctgtctgttctatctagttgttctattatatctttatgtatggtgctgtgttagttcatatcatccaagaagcagctgccaagatggaataagatgtgctagagtgttttggaggatcctttgaaggataatggagagggagcaggagaagggagggagaacctttagaatgatgcagggtctgacctgtgaagagggagataagagggaatattaagtaggaagagtttcagactacaatgcagatccaagaaagttttggccaggctgatggagaccccttgaaccaaagttacccattataggggtcctccatcttgtaggaatggcctgtattagtacagtcattggctggaagtagcccataagaagtgtggactcagcatgaatccagtactacattcagaaggtcaggagctggggctatcattcaattatgcacataaatagattgggaggtgcattttcatagctgccttagataatctaactatgaattttcctttttcctactgacgggtcatgcttcctgaatctgaaaattttttcagattctcagatttttaaatcagtcttagaatattctccatcatcattatttcttcccattttctttattttctttttctagaatgtttattagatccatatcatatcatttcattctatcctccatgacccttaacatttcttttagatttgtcatctctttatatctctgtgctgtattctgggtaatttcctcagatacacattcaagttcatgaattcttgcttgatttgtgcctcatttgctattgaactttccctttagcttttattttccattgagtttcacattttgatactatatatttttaggacaactttcttttaagtctatatgatctctttttaaaaatagtgctttgttcttatgcttttcattctttctttaaccattttaaacgtatgcattttttacagtctctaaacaagagctgtgttatctgaaattcttagggacctaatcttatagtttggtgaaccttttgtttcagttggattatttccttatataatttttaactttaggttgtgatcttatttgcatttgcctctgccaggctctctaatcctttgtattaatgttaatttctcttactggtagtcattagaacacatggatagtatacactcaactctaaatccatccttgatataggcccataattataaattctcaataacaattttctattgttttcacccagagcccagtccagggcagacaggcttctttgttatccctttgtgtgagtgggcagatttctttcagtatattctttttggaagtgtagcattctgggggtccatatattggcaacatacgggggtttcatttgcaaaaccctaccttatgaagaccaaagtcatcacctcctaattcgacaaccttagccttaaaacccatatctttatgttacctacttgcagagaagctgcaacatagactcctgaacatgccactcaggtttaaaattcccaccttggttttgactcctgttttgtttttgcttttgtttccacatattgtgagctcaatttttcatttaaaaggacacatgcaatgtttatccagtatttttacatgttttttttttttttgtaggctaaaactttttacattttctagtccaccattattgccagaagccgaattcttaattcctactctatattgcctcagggtagtttggttaacaaacagcaaaattcacttgccatccacacaccttctctttatagcataagaaatcatgatattagaaaaaaaaatcttgatacatctggtttcagagaaaactgcagtgcttccaaggcaactagaagaggtcacaggcatgcttaggcagataaattctagagaatgttttaaccaagcttgccattgtatcactaaaggaaaagcagaggtcttgcttgagagtattagaaaggcacattgctgcttttttagtgtaggacatcgtttgattcaaggaaattgccctaaatgttatgttttcgatcatctactgagaaacagtgaggaaataatcctacaatgacccagctggctagttgcgtaagttataaagttttattttgtcaataaagacttacttttcttaagaaggtttgtgttcctgagtcctataaaaactggatgaaaagaagttggctgctagattattaccacagatataaggtcccatctagtggcaaatgttcctgcaaactgaggtctgcacaattcatgaaaataagaaaaggttcattttttggcataattgacaaagtatgacatatcagccctttcaacatcagctttttaatgaaaatcttcttttatggcacagaaaaaaatttgtagtatacaatattattttagagtttttaccgagatgatttcagattattatttaccaagtatctattctattttaaagaccatatttttaaaaaatgtttacactttttatatgccatttaaggggcaaattttttattcatttaatatagaaaagtctcataattttaaaaacttttgacagtactagttgaatcttaccccggaatattccatggaaagagtagtataaagaatgtagggggacagggaacggtggctcacgcttgttatcccagcactttcgaagccaaggagggcagatcacttgacgtcaggagttcaaggccagcctggccaacatggcgaaaccctgtctctaccaaaaatacaaaaattatccgggtgtggtggcgtgtgcgtgtagtcccagctactcaggaggctgaggcacaagaattgtttgaacccggaaggcagaggttgcagtgagctgagatggtgccactgcactccagtctgggcgacaaagcaagcctctgtctcaagaaaaaaaaaaagaaagaatataggggatttggttcacctgcctaagagaataaactattttaagaactttaaaagcaatagtagtacaatgaagatttttattgtttttctttaaaccagtgagtctagaaacttctataggatactagtaagtagtgactaacattcatacagtgcatttgaaagtaactatcacacatttatattttaaatattatatggacttaacacttaatacaacttgactctccaactggcctgaattaataggatttttaacatctttctacacattttcttaaatgtaaatattttatatgctgagggaaagtagtttctttctcttaagctgttttcttgaggaatcattacattttcatgactcacacctttgaattttatcttttcttacaattccaaatcgagctgttcatgtctcttctctattccaagcaattctttgccccattcattttgaagatgtgatcagagagtaggtgtgagtggataatattcaattcaaacaacatgactacacataatttaaagcatccagtgcattttaaactgacatttaaggattgcgctggactaattcatcctgccttcttcagcttacgtatttctgtgcataattccttcttgaagttaatgggaatttggcatgtggcaggaatacatgtttcatgaaatgggaatctgggatctgtcatttaacaagaaatctgcttctaccttaattggtctgtctccctaatgtctttcactatactatagcagcataggctggccttccattttaatgtttaatgaaactattttaaattgaagactatatatgggttaccatgaacagaaagaaagtagtatgatctatgggactgaaggtgggagagttttgaaatgttgtgcttactgaacatagcttaaaatttaaaagttctgtgtgctacattgtaaacattttaattaataacacattgtttcactcacccatgccagtaaatgctgaaaaacatcttattcaacaggctttagaactagaactttatttttatgatcttttaaattaatttttatttataattgataaataataactatacatatagaactagaattttaaatcaaagaaaaagtaatggtttttctagttccttagtgctgtgcacggtgtattggagttcagcctttatatcagtatctacattttctaagtttcagttatgcaaatatgtacttcctatatgtaggtgaaataatttttagcatataaaacattttcaaataatgatcaataatttgccaacacattgaataaactataagatccatgaagggaatactatgcaggcttaaagaaaaagaacgcaagaaagatttctatacactggtatggagagatctcaagatgtattgtcaagtaaaaaaaaaaaaaaatggtctgggtgcagtggttcacgcctgtaatcccagcactttgggaggcccaggtgggaggattgcttgagcctaggagtttgagaccagcctgagcaacacagccaaaccctgtctctacaaaaaaaactaagaaatttagctgggtgtgatggtgcacacctgtggtaccagctactcgggaggctgaggtaggaggatcacttgagcccaggaagtcgaagttgcagtgagctgaggttgcaccactgcattccagcctgtacaacagagcaagaccctatctcaaaaataagtaaggtgtaaaaatgtaaatataatatactatgctttgtgtacagaaagagtgatattataatatatattctgatattctgtactggtgtgaaatataatggaaagatgaataagaagctagtaaaaatggttacagggggtggaggagaaatgaagtgggtggggagaaaagacaaagtgaaacttactgtacacctctttaaacaatttgtttcttagcttgttttgttacaaagcatgttaatgtaatgaaatgggaagaaaataaatttaccaatacacaaaagatgttttaaactgctttcttccaggaatatataagttaaaatgttggacctggattttttgtcttgactctgccactaattagctatatgatgttaggcaagtcactttactcatctggacttcgatatctgtaaaataagtaagttagaataaatagtttccaaggccctcctcagtcctttcattctaacatgcaaacaggtgacagcttagtttaggtgtacataggtcaactttttaaggattggaattgtgtctgattgataagaatatttattggtactctagagttcttctgctttggctaattttttctccagatgaaataatacttaaaatgagttttctcactcagtcagatagatacacattggatataaattacctttttaaaaagcaattttgctgcttttccaaaaagaatttctgtcttttaactttacgcaaaatcttcatacaaatatttactaaagtatcataaatgtactgacaccagatgaactcaaaacattgacttttaattgctaatcagtattttgataagcttctgagtctttattaaatatgtgttcatgtttgatatccattctgtttaggcttcaattatttaattacaggtcttgatatgaaactaatcatgcatatatccatacgaagcttgtatactgacaggataaaatcattaaacagtcattactgtaaactgacgttggcctgaaatttttgcagttaacgggggagttgatgcttgatgaacaatccaattaaaactggcaacaaaagacctaaaatgtcagccaaattgctttttaatagtcaatgtagccatcacaaaacataaacattaaagtccccatagaagcataaagcttcatggtgaaacaattctagaaaatgaataataattatagcatcttgaggattcttttaatagacatgcactcattaaaaatattttgttggttggaatcagatgacaaagtatgtttccctgaatattttcttacatttgttataataataattgtatttaacattagataggtgtaatttctattttctaaaaatgttattttaaaagcactttaataacctagaatacaggttttgaaaaagggaataagaaaaatgtacaatatgacctgctaatatctcaaaatacaaaatcataatgaatcctcagttacactgaactttaaataaaacacaggaaagccaattgtgatttctacaagtaatccaaaagcaatggacaacatttagattcttgcaactctctgagtgttcaatactgaatatgtgaatggattaatcacccagatgtttcctgctattcagcagtttgatttttagttgaagatacaaattctattatttgcatttttcaccattggttcagatgttttgcacatggaagccaaagaattagattgccgtgaaagattatcttgtatgttatgaataatccaacttcttcctctatcattactgccacatctttgaacaggcaaagaaagaaattgtggggttttcatctttgtaacattgtaacacaaaggaaaatatcaaatggctcctagggaaaatgttgaaagcatcagggttttaataataagtcatttattttctcagtaaacatttgctaaacacttataatgtgccaacatggtgttgaccactctgggaatctggagatgagaaagatttggataccatctgaagcttattatttagctgaaggttagacatgtaagcaatcacatacatgggagaaatgtataaagaattcaagccaggaaaataaaaaatacttatctcccaaactcacatgtgaattaggattatcctttagcctaccatatttttaaaaatactttgtagcatagatacacaacagtagagtcctcagacagatggttttctaatatgtttatgtattaaaatatctttcaattaagtattgccttcctctacaatcatagagtctaattttatgtgctatgaaggataaattgacgttcacacttctccagctgtggttcgtgtgttttatctgttgggaaagttagtgctctgttttcagagcaacaatttttaaaatccctcagaggagagatagacacattgggacttcaaagtctattagctgaaacactgaggagaaaaccctataggaatataaatgaaattttaatagcaccatatcagaaaatattaaatgacccaactatccataaaaatttgcttatcttttaggtttttttcatagtacaatgatgactaaattatagagagaaaattctaacatttaggctatatctctaaaccaccatctcagcctgtgggaaaataaaaatgccttggtccatattatgcacgtcgtcgaataaaatcatgtcagcaatttggttaagtgttggcttgaacagaccaaatcagccagctcctttgctattgtatgaaccacagaataataagtttaagcataattttctgcccctaaattaatattttaatatgtaatcattcagtaaagaacaataaagccttcggtgtaaaaaagaatagatagattgatagatctatctaaaaattcttatgaccacatgtaaaattgcattatgtatttttgcatttgcccaagtaaattcaaggtaaatattaatactatttgctcacatatttaatcaggtacctactatgacctagacattgtgcagggcaccaagattcaaaaatgaataataaatagacctcaccttcaagcaactcactgcctcactgacacaacacacacacacacaaatactcatgataatgttggtttctgatagataataagttgtgtgagaacacagaaaggaaaatggaagaaagcatcacagaagaggtaacattgcctaaaagacttccattcatgccttaagacctagctccactgagaagggtgagaagcaatagcatcaaagcaaaggaagcatgtataatacagtactgtggaaacacagatgtgcgtggcttatgcagagtagagagataggggataaagctgctggggtttataggccctactaatgattttgtactatatgttacatataatgaagagccattgtattcattgtaattaagaaaacagttgtggatttattcattttgattattcattggtaatacatataattaaataagctgttaataagttacagagatatcagatatcctaatttaataagaattagatctgtgaataccagggtattatctatagtcagtgtttcctacattctcctgaatatatttaagtcaggtgaagattttctaagatgatttctttataaagcacaattagcatttttttccacaaaagcagtaataaaaccaccatcatacctgtataaaaacccaaatttttatataatattccagtagaactcttaaaagcactcaagcaatgaaattaccggcacataaacaatacctaactcaaggattgccagaaaccatatttttattatctacaattattttaatgttaaaaccaataatgtggacattttggtggcacaaagtactcttgaactacttaattagtttaataggcaacatggtatagaacagtgacttttaatttatttttctcaccgtttcccacagttaaaatatattttgcatcataatatacaaaactgaaacaaaagtttcatgaaacaattaaaatctttactaaatgtgatgttctaggatatattatattctatttcattttttatcctagtcaaaattggtttcataacccatcaattgatcatagccagacatttggaaaacattgttataaatagaatagttgaaaataactggatttgaagtcaaaagatactggattggaagttgaaagacttgggttctttttctgggttctttttactgcttacaatctctatggccttagtaaagtcagttaactcctctggtttttgatatataaaatgggaatgatgccttccatgtctatctcacagactcctgttgtaaggagcaaatgagataatatagtgttttgcaaaccataaaacactatataagtgtaaggaggtgatatccataaaatgagactatacttcatagttatgtatttcatgtgactttcgtgaaccttttaatccttcaaattcactgttaaaaataatttccgtgacggtatctagtcacaccagatgtatgtgaaaataaggttgacaaagtgtttctcgttatgagtaaatgacataagttcaagtagagtgtatgtttttggcctctctgaaagaaatgtgaaacagaccagcaccctttaaactaaaagatagttaaaacaatgagaggaatgcatggctttatattatgtaatttgcatatgtgacacatcttttttgatacatggtgctgctgctgaagttagcctttggcaaagacgtgtcataaacgcatttgcagaacactaataggaagaaatctataacagtgaagagggaagcaggcaaatcattcatttgaaaaagcattgtttagtaaaatattattatgaactacctatgttcagttcttgccttgctaaaaatggatggaaattcaatatgatttgaggatgacttgtctggttttctccattcagtttttcaacaaacatttgctaagtactggctgtgtaccacactgcaggtgctatgagagtcattacctttcaaagggctttatcctctgttagggaagataaaacaagtatacaaatacaaagcacaacattaggcctgttggacgattgcacgaagcagagacttactcagactagctcagatgataaggatttattataagcgtgcatgtccaaaatctgaaaatgaaccaagctctagaaatttcagcagcaggagtttgtgaattttcaatccagggttctgctattcctgacacagtaactgcctcctgtctgcttttttctatatctgtctgttctctttctgccaccacctggcttcatgtgtcttaggaggtattgggggcataataggaaacagtgctataggtggtcagaagagattactgtagcttctttctttagatttcaaagaatggttaataaaaggggtaacattggtaatgggcctcagaagagtaggatgcaaacaatatgggatgaaaggacattcaaggtgggaagtcaagtatgaatgcaaagattcagagatggagagagcaccagtgggtctgttgaatggcaaatgttgcagtgtggctgcaggacaggaaatatgcaaaggtatactgggccaaaatcatacctttttaacccctcaaaaagtgttctaaaacttttgaatttaaatgtaatatagtcaatctacatgtgtacgtattttttaaatgtccaatagttttccaatgtaaaaaaaaaaaaaaaacagtccaaacaaagcatacctcaaaaatgtcttccattggcctttgcttcagtttattttgcagaaactggaacacatttgtcactccattgacaagcttatctagtgaggcatggcactaggcagtgtgtggattgataaaataagaaactccctgttcttagaatttgccatttagttgagggacaagacagacaagcccaaacacaaacataaatgtagcagaagcaggtatttttatacagctgtcactaagtactttcacactccctaaacactatacccagatattaccacccaatctccctcattggcttccttgcttacctattcagattcctttctcctcagtgtgctctaagcttcacagcaacataaaaaggtacctaattggttctctaattgaaatatctggtcttgggtttaaagaccatctaccaattgctgtccccacgcctgcactcatttgactatgtccatttaccacttctacctagtcatgctctcctctccagggaggcaaacttatttgtcactggaaaatattgtcctttgaggacctgaggtcttaatagaaggcagaagagcaagcaatgatcactgataaaatttgattgcctttgataaagtaacatgaataagggctttaaacataaatttctttataaacgttggattcaagtttagccaaaccctgcaaataaccattatatgttaaataatcaagatgtaccagcaacagtttttcccttgctaattctccaggacatagaaggtaactaatccaaggtgacacggttacaataggattcaacaaagtctagtctgttctgggatagaaaggtatattttgcttctttggaatgccctccagaaatagaagactatatctagggtgaacattccaacttaatcctaaatctgagagatatctctgtgcctattacctgattcagctactgacatagcactgatcaccttgtaaagcacacatataaatggctctacaatagagacctgttctcacatgaaacctagaatatttgtggagtgattattaatggattaatgcgacatttagtagttgcaactcagctgagaataggagatgagctcctggagacacaaagaacctcatgtctcaccatttcttctcactgactaagcttttcaaaggggtgtgtgtgtgtgtgtgtgcgcttttgagagaagtgactttcaccttcaccattatacttgggcacatagcatacctaacacttaataagcagtacaaaaatgtttgtttagaaaattaaatagctggcttgggctaggaaaattattaaatcagcattagcatgtctataatttttcccctctcttaattgttatatttacttctgctgctctgccattccctcgtaccattgcccaagccactgaggcaccctgctccctttcattagggccatttcccttccctgtgtatcatacaacttttctgtgaaaccttgtagactagtctgttctctctttttcaactctaccactgtttacaattacctgctcatcattccattgtattaatatgcatgtgcttaccctcctcccatgtcagttacataaccttttctgatgaccatccactattccttttggtgatttttcaggcagatatatctgttaggggaagaggaagaagggttaaatggcagatttatttctgtaatctttggaatgaggttagtcagtaaagactacacaagtaaagactacacagtaaagactacagcatcatacacaagtatgatgctgaccattatgtgtaaagctggaaagtgattatgacctggagtaaaggcatactcatctcaatggtcaccactggttgaccatgtaatcttcaacaaataacataaattttccatgcctcattttccttaccttatatttaaaggtaagtatttattgtaccagcaactttataatcacaataacttaccacatcttataatgagaatgatgattggaatgatatataaatggaatgctatttgcacctctctgtgtataagagagctgaaaatgattaaatacagtaacaaatcatttactcagaatgtctgagacctgacctgttctattatattggaatttagatatcctagttccaagtgagcataacaattttaaaggcatgttagctaatcaatttatgctatatagtgtaagatgcaaagtatagtaagaaataagttttaaaaccatctgtcttagaaagcatgacacataatatggaatgtaagatatggtagaaaataaacaagtttttaaaacatgagttgaagaaaacatttatttagtgttaatacattatctagatgagttggtgctatgtatggaattgtgtcccccaaatttatatgttgtagccctaaccaccaatgtgatagtatttagcaattgggcctttgggggatgattaggtttagatcattccatgaagatagggcccacatgatgggattagtgcccttctaagaagagacatactttctccccaccatgtgagaacacaacgaggaagcagctatctttttatttttcatggaagaaaatatttgcaatgtatttaacacaaaaggattgatattgggctttatgtaataatttcaaatcaattgtaaaagaccaaacatccaatgtacattaaaatggacagaagttataaagaggcgattcagttttaaaaatgaaaaaataaaatttaaatggctaacaaactgtttttaagatgctccacttcacttgtaatcagaatacccacaaaaagttgtttaaaattataatccatttatattatagaatactatggaagcattattttttaaattaaggtctatttgtatgtacatacgtggaaagatctccaaatgcatttcttagaaaaacatgctacaaaacaatggaaatagtatgatcccattcatgtttttttatttttttatttatactttaagttctagggtacgtgtgcacaacatgcaggtttgttacatatgtatacatgtgccatgttggtttgctgcacgcattaactcgtcatttacattaggtatttctcctaatgctatccctcccccctccccccaccccacaacaggccccagtgtgtgatgttccccgctctgtgtccaattgttctcgtcgttcaattcccacctatgagtgagaacatgcagtgtttgattttctgcccttgagatagtttgctgagaatgatggtttccagcttcatccatgtccctacaaaggacatgaactcatccttttttatggccacataatattccatggtgtatatgtgccacattttcttaatccagtctatcattgatggacatttgggttggctccaagtctttgctattgtgaatagtgccgccgtgaacatacgtgtgcatgtgtctttataatagcatgatttgtaatcctttgggtatatacccagtaatgggatggctgggtcaaatggtatttccaattctagatccttgaggaatcgccacagttttccacaatggttgaactagtttaccctcccaccaacagtgaaaaagcattcctatttctccacatcctctccagcacctgttgtttcctgactttttaatgatcgccattctaactggtgtgaaatggtatctcattgtggttttgagttgcatttctccgatgaccagtgatgacgagcattttttcatgtgtctattggctgcattaatgtcttcttttgaagtgtctgttcatatcctttgcgcactttttgatggggttgtttgatttttttcttgtaaatttgtttaagttctctgtagattctggatattagccctctgtcagatgtgtagattgcaaaaattttctcctattctgtaggttgcctgttcactctgatggtagtttcttttgctgtgcagatgctctttggtttaattagatcccatttgtctattttggcttttgttgccattgctttttgtgttttagtcatgaagtccttgcccatgcctatgtcctgaatggtattgcctaggttttcttctagggttttctttggttttaggtctaacatttaagtctttaatccatcttgaattaatttttgtataaagtgtaattccctttgaaaactggcacaagacggggatgccctctcgcaccactcctattcaacatagtgttggaagttctcaccagggcaatcatgcaaaagaaagaaataaaggggattcaattaggaaaagaggaagcagctctcttaaagcagctatcttcaagctaggaatagagccgtcaccggaaaccaaccatactggtgttgcagaacattctctttagttcagctaaaatcaggttcttgtcacacgaccaggaaagatgaggcttgcggacacatagaagggtgaggagtggaatttactgggcaaaaaggaaaaaaaactcagcaaagtgagatgctaacaggccctccacttcacagattgaatcccaggtcaccacacaggaacaggagaggttgggctcctccccactgcaaatggggagaacttcctgaggctccaccccttcctcccagtgcacaggtgggctgtattcagagacaattagtcgtgaaagggtgggcttcatccgggaccagcagtctggtttttcagccttcaggctattataggcttgaaagcagggttttgccggggactcttgactgtcacctgtctctatcactggtactttgaacttctagtctctgagctgtgagaaaataagtttctattgttttagccacccagtcaatggcgtattgttatggcaacctaaaccaagataatcggctatttattattttatttatttagaaatatggatgtatatctccaggttttgttggctagcaagcacatatcttttacttttatcattacttgacacagcccaaattttccaaatacaactgattatttacattaaggaataggctgtatgatatatatgtacacaattcagtgcattaaaatggaactggagactattattctaagtgaagtatctcaggaatggaaaaccaaacatcgtatattctcactcataactgggagctaatctatgaggatgcaaagacataagaatgatacagtggactttggggactcaggaaaaagagcaggagggggtgagggatgaaagactacaaattgggttcagtgtatactacttgagtgatgggtgcaccaaaatctcacaaatcaacactaaagaacttatgtaaccaaataccacccgttccccaaaagcttatggaaataattttttttttaaaaaactatttctatctattaaaacatacgttattaagaacactacaattcttgggttaccagcaaaatctgtgttgatgaccatgtaattatccattataacttgtctgccctattcataacgctttcatttgtccactgtgatattgctgacccacagaatcacactatcgccatgtgatttaagtaaaataaaagattgaattatttattcaattatttatagataaatattccattcaatgaagaaatggcatgactttttattttgataaaaacacataaaatataccatcttaattttaatataccatctccaattttaagtgtatggtacagtagtgttaactatgtgtacatttttgtatagcaaatatctggaaccttttcatcttgcaaaatcaaaaatttatacccattaaacaacttccctcttccccctcctctcaactcctggaaatcactattagtactttctaagagtttgactattttagatttagattcctcatataagtggtattatgtagtatttgtccttctgtgtctgacttatccacttagcataatgtcttccagattcatcattttgtgcaaatgacaggatctccttttttaaggctgaataatattcaatcatatgtatatgccacaccttctttatccgttcctcccttgatggacgtttagatttcttccacctcttggctgtcctgagtaatacaatggacgtgagaatgcaaatagctctttaagatcctgttttccactcttttggatatattctctttaatagggttgctggatcaaatggtaattctatttttaattttttcaaaaaccttcatacttttttccatagaagctgcacctttttacattcccaccgacagtgcacaaagattccaatttctccacatcctcaccaacactttattttccatttttctttatactggccatcctaatgggtataagataatatctcctggtggttttgatttgcattacgctgatgattagtgacattgagtatcttttcatataccttctgtccatttgcatgtcttctttagaaagatatctattcaagtcctttgcccattttttaatcaagttgtttagtttttctgtttgttttgttttgttttgttttgttttttctgctattgaattgtatgagttccttttctattctggatgttaatctcttctcagctgtatggtttgcaaatattttctcccatttcataggttgtcttttcactcttttgattgtttcctttgctgcacaaaatgaacaatcatttttaaagccctttttcaaaaaaattctgttgttcagatacttctactcattatactcccgtataaacaaacttctgttaaaatgtttagggaattcgaatgcttttgtttgtttgtcttacattttcagttctttcaaatggagatgttatacaaattgagtgtattagtatgttacattatgaagaatacaataatttacgtgtaagaagttccccaaatccataaaatataaaataacattcaattcacattttttaacaagacagctctctagtatccctcgaattttaagactagattttggcatacctatgaagtgctacactatgtatttatttaatacagccaaccattagaactattatactgagtgacaaagatggccgaataggaacatctccagtctacagctcccagcgtgagcgacgcagaagacggctgatttctgcatttccatcagaggtaccgggttcatctcactggggaatgccagacagtgggtgcaggacagtgggtgcagtgcaccgtgtgcgagccgaagcacggcgaggcattgcctcactcgggaagcgcaaggggtcagggagttccctttcctagtcaaagaaaggggtgatagacggcacctggaaaatcgggtcacttccaccccaatactgcgcttttctgatgggcttaaaaaacggcgcaccaggagattatatcccgcacctggcttggagggtcctacgcccacggagtctcgctgattgctagcacagcagtctgagatcaaactgcaaggtggcagcgaggctgggggaggggcgcctgccattgcccaggcttgcttaggtaaacaaagcaggccggaagctcgaactgggtggagccaaccacagctcaaggaggcctgcctgcctctgtaggctccacctctgggggcaggacacagacaaacaaaaagacagcagtaacctctgcagacttaaatgtccctgtctgacagctttgaagagaccagtggttctcccagcacgcagctggagatctgagaacgggcagactgcctcctcaagtgggtccctgacccctgacccccgagcagcctaactgggaggcaccccccagtaggggcacactgacacctcacacggccgggtactcctctgagacaaaacttccagaggaaccttcagacagcagcattcgcggttcacgtaaatccactgttctgcagccactgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggtaaaaacagaacagaaaaactggaaactctaaaaagcagagcgcctctcctcctccaaaggaacgcagttcctcaccagcaacggaacaaagctggatggagaatgactttgacgagttgagagaagaaggcttcagacgatcaaactactccgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaataaagggtatcagtgatggaagatgaaatgaatgaaatgaagcgagaagggaagtttagagaaaaaaaaaataaaaagaaacgaacaaagcctccaagaaatatgggactatgtgaaaagaccaaatctacgtctgattggtgtacctgaaagtgacggggagaatggaaccaagttggaaaatgctctgcaggatattatccaggagaacttcccaaatctagcaaggcaggccaacattcagattcaggaaatacagagaatggcacaaagatactcctcgagaagagcaactccaagacacataatcgtcagattcaccaaagttgaaatgaaggaaaaaatgttaagggcagccagagagaaaggtcgggttacccacaaagggaagcccatcagactaacagcagatctctcggcagaaactctacaagccagaagagagcgggagccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaaggaacaaccagtaccagccactgcaaaatcatgccaaattgtaaagaccatcgaggctaggaagaaactgcatcaactaacgagcaaaatcaccagctaacatcataatgacaggatcaaattcacacataacaatattaactttaaatgtaaatggactaaatgctccaactaaaagacacagactggcaaattggataaagagtcaagacccatcagtgtgctgtattcaggaaacccatctcacaggcagagacacacatagcctgaaaataaaaggatggaggaagatctaccaagcaaatggaaaacaaaaaaaggccgggattgccatcctagtctctgataaaacagactttaaaccaacaaagatcaaaagagacaaagaaggccattacataatggtaaagggatcaattcaacaagaagggctgactatcctaaatatatatgcacccaatacaggagcacccagattcataaagcaagtcctgagtgacctacacagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacattttgttcagcaccacaccacacctattccaaaattgaccacatagttggaagtaaagctctcctcagcaaatgtaaaagaacagaaactataacaaactgtttctcagaccacaatgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagacggaaatttatagcactaaatgcccacaagagaaagcagaaaagatcaaaaactgacaccctaacatcacaattaaaagaactagaaaagcaagagcaaacacattcaaaagctagcagaaggcaagaaataactaaaatcagagcagaactgaaggaaatagagacacaaaaaacccttcaaaaagttaatgaatccaggagctggtgttttgataggatcaacaaaattgatagaccgctagcaagactaataaagaagaaaagagagaagaatcaaatagacgcaataaaaaatggtaaaggggatgtcaccaccaatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaacgaaaagagtccaggaccagatggattcacagccgaattctaccagaggtacaaggaggaactggtaccattccttctgaaactattccaatcaatagaaaaagagggaatcctccctaactcatttatgaggccagtatcatcctgataccaaagcctggcagagacacaaccaaaaaagagaattttagaccaatatccttgatgaatattgatgcaaaaatcctcaataaaatactggcaaattgaatccagcagcacatcaaaaagcttatccaccatgatcaagtgggcttcatccctgggatgcaaggctggttcgatagacgcaaatcaataaatgtaatccagcatataaacagaaccaaagacaaaaatcacatgattatctcaataaatgcagaaaaggcgtttgacaaaattcaacaacccttcatgctaaaaattctcaataaattaggtattaatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaactgcttcaaaaagaataaaatacctaggaatccaaattacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaccaatgactttcttcacacaattggaaaaaactaacgttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatcccttccttacatattatacaaaaattaattcaaggtggattaaagacttaaacgttagacctaaaaccataaaaaccctagaagaaaatctaggcattaccattcaggacataggcatgagcaaggacttcatgtctaaaacaccaaaagcaatggcaacgaaagccaaaattgacaaatgggatctcattaaactaaagagcttctgcacagcaaaagaaactaccagcagagtgaacaggcaacctacaaaatgggagaaaattttcacaacctactcatctgacaaagggctaatacacagaatctacaatgtactcaaacaaatttacaagaaaaaaacaaacagccccatcaaaaagtgggcgaaggacatgaacagacacttctcaaaagaagacatttatgcagccaaaagacacatgaaaaaatgctcaccatcactggctatcagagaaatgcaaatcaaaaccacaatgagataccatctcacaccagttagaatggcaatcactaaaaagtcaggaaacaacaggtgttggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgccgctataaagacacatgcacacgtatgtttattgcggcactattaacaatagcaaagacttggaaccaacccaaatgtccaacaatgatagactggattaagtaaatgtggcacatattcaccgtggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctgggaactgttgtggggtggggggaggggggagggatagcattaggagataaacctaatgctaaatgacgagttagtgggtgcagcgcaccagcatggcacatatatacatatgtaactaacctgcacattgtgcacatgtaccctaaaacttaaagtataataataataaaataaaatgaaaaaagaactattatactgagtgacatatgtagtgatactatttctagagtttctagttgaattaccataaccctaaactatcctcataattatctattgttgtaatctaacatgtatttagagaaggaaaatccctacatgtgactcatagtttaagataattctttttattgtaataacatttacttgaagccaatttggtatttcccatagtagagagatggtcatcatgaatgccagttattgtattaaataagaattttttttaggtacataatatttcatttgtaaatgtggttaaactttaatgtgcaggaagaaaaacagcatacataaattgctcagttgtctttttaaagcaagcccatcaagcagcctcttctgatattttcagcatcaacttgggataaaatgacacaccaaataagctaacaactgttactatagattacataaattatgtaggtgctactgaaatgaagatatttgctactcaaaattaaaaggaaacatttaatgatgtgtgcttgagcatattgaatcggacttacaaataaaataacccactacatagatttcattataagttattacatagctgttcagactcagcattttatattaattgtttgcaataaagaggaatgacaagattggtataagcacagttggtgttgtttgttttgaaggccaggagagatggctgagtggcaacaaatggaatcagtgcaatactatggtacccaaggccttgcactaagttctccacatctctcagactcatattctccatctctaaaatgggcacagcatatgaatgttgaaacactgtgttttcttcaaggctgtggaagttatttatagcctcagaaaactttaaaaattacacattcttaacaataatgactctttttttcaaacagtccattttcacagcataccagttatgtgaacaagaatgtaaaataagagagactagagggccaaaaataaaaacactaaaaagaagtaaatgaaacttgtgatatctccacagtcagtgtgtctaaattcatgttatttttttcatggcaccaataaaatttactaaaactttgtaggtcacttatttcatttgggttataaaaagtctctaatttgattctgtcttccccccagaaatgattagccactcgttttaatggaatacccacagccatagtcttcatgacaacaagactctgtgtaaatggtttcagttggaaggtgggaagaggccttaacatctgtgtagccttacctctccccatcttggtctactgttccaacagaggaaggggacatgtttttcttttcttcctactttgcaagtatatatcctaacaggcataaggaaaagaagtaatagttgtagcagtagcagcaacagcaacaaatgtgaatatatgtaagtcatcactgaattctttgaaagaaaattggtttcataatctaaattcatactggaaataattacaataataattatattagtaactaacattaactgaatgtgtcacatgtaccaggcactatgctaagtatttgacatacaatcctggtctggtacccatgctgtttacatatactataattaatatgcaatgctttaatgaatatatttggatacactatgaggcaagtcgtatgtcccaaattaggttgatacacagttacaaaattgagcagatagctttcatttataatgtggatgttggtcttaatgccaatatgataaagttcctgtttatttgctatgagcggtatacctacaaagcgccacatttctaaatagtcgtcatcgtttgttaggtggtatttttgtatatactatttaaaaatgtttctgagcattcctgacacttcaaacggttatccacaactccttccctcatggggtttgacgtactgtgagggaattatttgaaagccagttttgcttgcagcttggcccagtgaataaagcatcagataatatttgtgaaagtctttgaaagatgcagatgaaaggtgcttcataaatacaaagcactaatgttgtattcatggaaatggctcttcttcacatcctttgctctaatgtctgagtctcaaggtgttattgcaatggatactttagaaatgcatgtatacccccagatcattttagtatagaggaaaatgcaagtgaacacagtcagagtacttaactaaaaatcatgaaatagagactattatctgaagtgaaagaaacttgcagcataataaagaagctgatcaatagagagtgtttggtgtggcttggaggaagaggaaaagaaaggtgtcaactgttcttatattgactcatgacttcaataatagcttcttagaacttttagaagaaaataagaaaactgaaaattgtgaaaaaaaatcaactataatgcagaagttttaagtaatcaagtgtcttggagtcaagtagattatcctcttaggctacttactagatggcacctgattttatagatttcattgagctcaataattgatcattcatttaataatattatttagtgcttactatgtgccaagcactctgctaagtgttttgtacacattacctcatttatttcttacaaaaaacattgagatgcttattactatccttattttacagatgaagaaacaaaggcttgaaaaggtttatagcaaactgatagtaaatgacagagctgtgatttaaaccgacataggtctgattctaatatctgtaacttaaccattgtgtcattcgaaaatgttatgatgtacttactaatttaaacaagttatatacagatgatatctctaagtaagtaaattagtagcagagaaagtactctacacttgattcaccttattgaaaacaaacaaatgaaactaagacactctcctctttgtcttctactactaaatataaggtgttccctaaacgtttaggttaatttctccttttctttggcttcctcatcatttattttgtaagttataagtaggataagccctactttaaagaagagtatagttcagtagtagacagcacttgaccttttattctgtacacataacaataaaatttaaatatatatatatataatctctctctctatatatatatctgtataccttgacatgcaacccattttgtatgtttatcactagaaagccctatgatacacaatgttcaaaactacccagaatgggaaacatctaagtcctgtactgtaagtatggaaaagaggaaattgccctagtgctgccagggcaagaatttgaagatcaggtagctggtcagtaagcctaagtgacaatggcttcctgagtaatggaattatgctttacataagcagtttccaaatgctgatgagaccaggagcataaaacagagcaattccatagtagtatgttcttttaccctgagggggagacagctcactctgtgtgggctaccaaaaccagaaaatgagggcttgtctccatgaagtacaggggaagcaaaagggaaccatgtatacatgcttgcattttaatttcatttctatcctttgtggtacgtgtttgctatttgggagtcaagaaaagtaaaagcaaacttgaatcaaatccaggttgtcatcattcccatccaggaacccagatcacactctgtggtctgctctggtccagacctccagtgttaatacacagaaaggagcgtctgtgcattcattcactgacttcaggcactacaagaagtctctctgagaaactgtttcacataagtaatgtatgtttaatctactgtccctctcagcatctcacctatcatacatatgtattttcacaaggtacatgagtaccttttgaaaaacttacttgaatgagcttaacgaagaactaaattgcttaagagataggttggtgcaaaagtaattgaggtttttgccatcactttccatggcaaaaccgcaattacttttgcaccaacccaatacttgcttaaaggacatatttatcaatcactacctatgaaatcatttcttaatttctaggatttccatctatatttactactgcagtctcatattcacagcttcattaacatgtgttctcatttttttcttctgtttatgcaagctgactctcttccccttgagatgagctaatttttttcattttctgaaggcatctatacattatgttcatttcgctggaggggagtacctgcattcactgttgttcaattcattctaatatcatatgagcagattccactaatttgcgtttttattttttttaattttatttatttatttatttatttatttatttattgaaatagtcttgctgtgtcgcccaggctggagtgcagtggtgtgatctcagctgtctgcaacctctgcctcctaggttcaagcgattctcctgcctcagcctcccgagtagctaggactacaggaacgtgccactatgtccagctaattttgtatttttttgtacaaaattaataaatttcataatttagtagtttggtttcactatgttggcaggctggtcttgaactcctgacctcaggtgatccacctgcctcagcctcttaaagtgctgggattacaggcctgagccactacccctggcctaatttgcttgatagacatttcacttgatccactagcagacacatctatatcaatagatcagtatatttcctaattgagctgccttctcacaacttcattagccatattctagttaatgaagtctcaagtgcaatctacacatagtttgaggctacatgtgaaaagacatcattacaaaagaatttatcagataacttttttgtattctgggtgatgttcatccagaatgttgcattttgtttggggaaccataaagacctagttaaattggagtgagtccggggagataagcagtaatgtaattgagagaatgaatcagactttgaaggaaaaataaaatgacttaaatatgcatagcttagcataagcaaagtttataagataggcttagtaataggttgtaattttggcatatctcccaaaaaatagctctatttaacatttcactaaaatgccatgttgaaaaacaagaagatgaaaatttgtaataatgaatcaatcaatgaacatttcaagcagaaaacttttcagatacaggctgtgcccacacaatgccaaaacagctgttaggaatgtgaataattcaatcaaataagttatttggcatcataaaacactctcacccaccatggttgctataacttttttataaaataaaacttgattgaattcaaactttaaatttttgaattcactcaaattaattaaatttgtaaataaacaaaataataaacttgaataaaattatgggttgtatgtgggagatataaagatgattcagactcacatcctgatacaagacaagtatatgcatagcttgaatgcaagaggggaaataaaactttctctgtccttcctacagaattgttactttcctgctcatacttcttaggaggctccctcactagcccattagatgtcagacagaaagattggtggcagccagtagtgttctaccagcaatcattaagatcataattctgaaaaaaaaatgttttggccccgacatatttgaataacatgtacatgttactcatatgagaataccaggactcctttttttaatgcttcctatttcctttttgttgttgtcgttcagaggggaaagataagcaagtcttcgtccctcccatggtatgagtagaatcactttacaagcatatggatatgaaaatcacttattacaattgcttataagatcagagttgtacccaattcctatcactagctataaccccaacccctttctctcccatccaagaaagcacatccaaatgcaactcagtgagagtggcactattagaggcatcaccctgagtccactcatctatactttttaaaaataaatcatttgtgaatttcagccctctattatagcaacaggtgaccgcaaaacattggcatgttttgatcctatatctgagcattgctgaactggagcaaagggccaaaacatgagtgaaatttgagaatcctctggctcttgtgaatactgctataatagtgacatctcttcccattgtcccagatgagggctatgtacttgtttagctcccaattatagatgccagggttcctctccatcactccattaggtgtccatgagtgccctttgttcttaaagttgtgctggtggagaggaactatggagtacaggggatctttcttgccaaataaccagacaacggtggttacgagaacattttcttcagcctttatttgaaaaatttggacaagggtgaaacctttccgaggcttccctagcctctatgcttttttatactctagaatttttgccttttgctttttttgtttattcttaatatagcgtgccctcactatttaacatatgatagcttgaaaaatacttttcttgaaacttcagacacagttgtaatgttttcctgatttgtgcttcaaacattgcgttctatctttataaataacattggagcgatttgcattctttgccttttgaacaaatacagggtgaccatttataacagtgtaataaaaataaagccctgaaaatgaaaactttataaatgttcaggatatctcttattagctaattcattaaatgatacactgtcaattaattcataaccctccattacctacctgcaaataaataatgaacttgaagattgaaaataattgaaatacctacataagactttagtttgagtataaactaaatatgaaattttaaaggatcattacttttttatattttctttttgatatacttcactgggtaataacagaagccacaatatcattgtcaacataagataaaacagggcaattatctatttcatgtttcatggtacataacagataacagtttctttcaaggctatagtgaaaaggctttggccaaccactaattttaattgctaactaataccgtatactaacgtttaaatattgacatttaaaattccaaattgtgccataaagtagagctctttaccactctacttagaaaaatgacaattttctaagatgacaaatatattggcttcatttttcttttttttaacattacgaaactactctacaaatattagcagagttatatccatcttgtattttcacaaccaagaaaattaggtagtttgagcaattactacaataatttaaacaaaatggcatttaccacagccttatctttttttcttgattgtaaagtcctggattgtttgactgagttaaaaaaccagacacttattggcaggaatattgagtattatgcctgaggttggctgattgtactatgtaaaaccaatacagtgtacagcacagttggcttccctctataacagagacaggaagaaatgggctgggggagggctgctttgtggatctttgactaacttgtatgcttgcacaacaaattggagaacaggaaaagagattaattaaactagaaagtagaaaatttggactttctggatgtagaccagcactccctctaaagatgagtatcagcttatagagagactaaaatataaatatgaatttcagcacaaacatgtcaaaggatcataggtgctttattgttgaccttcatttccagtgattgtaacaaagatcaacctaactgacagaaattaacacagcatactatatcttacctgctggcttagtgagagggccattcaaagtcctcaaagggatgtacttgacaatccgaaaaacagtaaatagtatccagggctgtggaagccatgcagaatgcagtaatccagaaccaggttgagcccatggaaactagaaaacattgtaatttattgttagctttcccccagagcctctgtgactgttctccttcagtcatctgcttcagttgtgatatctcctctctatttctctctccttctgactctttctgttgttgtctgtgcgtcactcatgcacatgcccatttatacataagtatttattaagcattacctatcgaatggactttatttccattctcaatccaatggtttatttaactgataaatctgcttttaataaaggatgttggtatattaatattaaagcagtattatttgagccagaaaagtgataaactgtattgtttattttcttctgaaaaccagttttcttacctttttattcttttgagcctctaataataattacgaggttgagaacagaacagccagatacatttaagtctaatttgatgatcattgagcactatgaagttaatggatattagccgtaacatgcaaatcttaaaactacctgctcacaagttacaaaagctctttgtgacaggtaaaataccattaagtagtaacatacattttgagttagtagtaatagttaatattaataagaaaatatcttctctttcttttaagcctgtttccttttaccccctactcctgcctagaaggggagggcagctcagaaaagcaacctcaggaaccaaagacttctaattggccttgagagatctgacataagtagtatggcaataactcttggtgccctgatgttctttgcacgtgtagattatatggtcttcagaggcattaattaatattgcctcataagagctcaggaaggtggttaaatactaatacaggcccataatcccttatccaaaacctttggggtccacttttttcagaatttagaatttttcaaattttacaaaggtgctgctgtacatatactgtatattatatatacactcacccagagtgaggtatgggccagcaccccttaataaaatgcattaatactttcttacctaaatgtatgaaaattcacaaaataagataaataaatgaagactataaatgtcctcatatcacttcaggtcaggctttgccaccaaaatttatgaaattagataaataagtaaagaccataaatatcctcaaagcatttcaggtcagcttttgccacccagtgagttaggggaaaacaaactcatttttcagagattctttgattccatagttgtagataaagaattgtggagctacccttccccttggccaaggagataatgaaacacatactaagaccaggaagtacagacatgatttctgactctccgtgacctttttctagagctataggaatatatgtgccccttttgacaacgtacactgcatagtaaccttgggaaaaaacatatttagggaaggtattgtcacagtgtcactaaagaaaagaatgatcaatttagtacatggatttcagaaaagctagccatgtatctactttggtcaaatttttcaagaaaaatgtctatttggcattactgtaatactgacaatatttatttttaacacctaccgaaaattattttgcatgtacagccagtgctgctacagtgctcgttttataaaggttaattttttcctttgccattgggatgtttgagaacagtttgaacttaagacaaattttgcgtttgcatatgcgcaattccatctgttaaaagcactagatgaatgcagaaaactgcatacagcagaatgaactgcgtaagaatacacaaaatgggcacatgtatatacctgcaatatccatcagctatttcagctcaccacatgtggataggagcctgtcccatccacatctggtatttagaagtttccgtcctaatcagataactttccttttcaccacttcacaataactcacaatttgcaactcttctggcacccactttcacaagataaagtgtcatatttggtatggcattcgcgtatcccttaaccattaatatatgacaaactatgctgtcattcttattaggttcctttttttttaatgcgtcattgattatgtttctgaatgttgcatccctaacttcattttttccataaccctttggttaggtgtgattttgcatagtgcagtgaattgcagaaatgcatgctttgtcttgtagcagaactgactgtatatgttaatgaaatgtaagggacaaaacaccctgatagacactctgataagttgccacagtatttctgagcagagatactctaatttcttgtgaaagctttctctaacacattatccaaaataaggtgtattggcaaaaagagaagaaaaggaaaaaagaaaaaactatgcgtgacacgtttcttcttgcacttaccttttggagacagaggcaatgttgtttctgaaggcttatacttctattagtagctctgccacacttaaaatgtctcaaatctacagtttggaggaattttgctcctgagaaattatcttaccaagttattttaggacctcaaacctgaaactggctactatccaagtatattatgtgaattagacctttccatttgaaaacttaatttattttcagaaagctttgtaagtaagtctggatatctacatttgcataatcaccactccccccttctcccttcctctctctggggcacagaagtgtatggttgccagatacatttggaagtgagtgtatgtgactcgcaaacccctagaattggtgttctagagcttctgacactgaacactaatgtatttttcattagtgtttaatgttgggaaatcccatttcatggatcccaagtattaaattacttcatttgggagggaacaagtgcattccccatctttttcctgaggtgaaaaaaagaatgaatctgagatcatttgcatttcataaaggcttaaggtctggatgtattccactcagtgcaacaatccaatattgtgaaagcgtttaaagacaatatgaactagcagggaaacttccacatatttgaaatgtggaaataaaaatacacagtaaaatagatgaaaatcaaaatatccatatatgtatatggatatgcattatacgtagataatctaaatgactagacaaagccattctacctgcaacagaaataataatactatgattgcacttttcaatgaagtaaaatttttatcatttttcataatagagttgcaaagattgtgaggtaatctagcaggcaataaatctgatgtcaatgagatattctttttcttttgaacaactgtactgaagagaaaccctttctcttgcacaactgtgctgacagaaacccctactgattaagctagtaaatgtcatgcatgttgtttagaggggttctgagcacaagacctcaaattgactcctctttttcttctaaccttggacttgcaccttttcctcccttccctcgggtcattaagtgctctcccacacgtggcattagacagtagatctgtagtgtgtcactggtgcttttttcacatcatgaaggggcatcattttaagcaccttcttcagagtatcattgtcctttgtcatggctctgggaggcattccactaagatcttcaaggggaaaacctacttctctgtcaattgaatagatagccagtggctacatcagaatgagagccaaagggaacacagaaggtgattatctgggtcccatgatccagtcaaaccctcttctattagcaaaagattttagagatcttgctctgtacccagtactttgctcaatgtcatacagcatacaggagaagtagaaggaaaccttattctaagaaacatgcagtctattttgggagaaaaggcaaaacacatagaatatgatggggatgctataatattgccaactcagggatcaaatttatggcaaaaatagtaaatgttaaagtcatagaagagagtcatgtttatgttccgaagtagcataatggaaagagtgctgggcagagtactgggatttcagataacataacccatgggggtgggggagagttttaagttcagtctatctgttaaaatgtcacttaatttacaaaaacacgtacagaaaaagagtaaagaaatcatctggcatgggcaggaaaaagtatccaagttgaatgaccttgagcaagtcagttcacctctttgggtcttgggtttctcatctgtaaaatggcgagtggagagaggcaagcttaactaggtgatccctatgatttcttccagccttatagttttatacttttatacttttattacattcaataaagaaatagtcaataaaatgcatgctcaagcacattttacatgaattaaatttaattgttaggaaaagggattattattatccttattttacaaatgaggggttaaagcttctaaagggtagaggcagaacttaaacccagatttgccatacatcccagtccaagtcctctcctctttccactgtgctgtgttgcataccattacaccacactgccttcctttctacatttaaggagtcatggtcaaagagaaaagcagacgtaataaacctaagtgaaaaatcaagaaaatgtggacaattctttgtctctaaatcttatgaaggaaaagagaactcatattacagagatctgcaatacagggaatggagcattagccagagagtcaagagatgtgagttctagtcctggccatgccactaacttgccaagtgtccctggacttgttttctcatttgcaaaatgagagcatctccaaagtcctttgggtttcaacattctatgcttctttgagtccccaaaatggaaagcacacttctagttacggttatgagtatgagcccagaggtttaaaaaaagttaatgagatgttaagtatttgtgatgattttttttagtgaatatgggatttgagctgggcctggaataatgggggtgacttaggaaattcatgaaacattttagttcttttaaaatatacaaggatagctgaccatctaaaggaatcctttttataaaatgaatgatcaccactcccttctctatctatcttttgtacaattcagattttcatatagtgagtttatttaaagggagagccacctgtgctagaaaatacagccaagaatttgtcatgctcttgggaggctaatatcgtttttaaaaataaaaaaccatgccaatgtctttaaaattcaagtttgaagtaaaaagattgaaagaagtgattttttttttttctgtgatcagccactgcaaagtgggcctcagcacaaaccagctgagtcctttgctaggcatcgaaagcctctggcgtttttctgcttttcaactctcagtcatttgggaggtgggacaaggccatgctgtccacaaagtttatccagaacgtgctggtgttacaagaaatcacttgacatctattatgtttctcctgtggaagagaggtggctatcagctacaatagtgatttctttttaaaggggtttaattgaggtatttctcatgggccaaattctaactcactgtctttacgtgtgcctgccaggaaaacaatggaaaaataccaagcaatagcaacaatagaagcctgaggaccgctgtcccaggctgcccctctgcaaacgagcagaaaaaaaatctgtttccttgctgcctaagctgccgctaacatggcagagctcctagaaaggtgtggcaaaggaaaaaagttgcagactgtgctttgcatgaccatggaaatatgtataacaacttgaacaaacttcttttagcctaccttttacaagtagcactctagttggggggctgacaaagagattagtttcacacagccaagcgacacactcgtgagctgtttttctaaaatatggatttgctcccgtataggcaagctcacatcctttcctgaggtaagccagaaggtggccttatatttttatttgaagtgccgaatgattttccttgcaacaaatttgtgccttttactagcattttctgaagtgagaattttgcaactgatggaaatcagctcacttctgttctgtaacttggtgtcttgttgatgatttatttgttcagtagcagaaactatgacaaatggtgtgaggcggcctcatttactttttagctgctatagccctaaagaatttacatgtaaatgcaactgtgaatgttttacatttcataagcatgctgcacgtgcttttgtaagttaagtggcatttttacagatagactgaacttaaaacaacctccctcaccccacaggttttattatctgaaatcctggtaagtctgtcatgctggtttccctgactgccaagtgggagagtaagtctctattttatgtttctcttctctcctctttagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggtacttgagctattattgatcccactaaacttaagtattggcagaggatggttctactgattgcagaaactcatttcatcacacacatctgcagagacacacaaatgcacaaaccgatacacacccagatgcatgggcaaaaaggaagactccttcacaggcgcagatgtgcaaacagacacaaacatctagatccagccacagccacagaccaaagcagatacacgtgaaaagatgaagccgcagatacataaacaccctgctgtcacatatccacaaaaacataaaacaaagcaattatctaagctgtcactgcagcctcaaagtgaaaggcaattgtcccttgttttaaaaaactgcagtattacaagaaaacccaaacacaactggaggaggagtgatcatttctattttatttattgtaagattctttgaaaaaataagttgccttcaaacattaaaaaaaaaaaggatcagcctcatgtaatggaagtatatgtgtaagtttaaaaactaaattctgcctttagggtgaagcttttggtcttttgagcaaaaaagtttgcctctgtttttcttcacatgtttagatttctagattgactcctcagagctttgtcatgataaaagttctactctttgcagttctaggtcccttgatcatgatagattttagcaccagatacaattaataaagaaattattcatcatttctagtcactttcttaaatcaaacattacaactttatattgacatagaaaaacactaactaataaaacatagattctattttctttgaaattcaaggacttccccttgtttttttgtgtgccttatttagttctacaatggaagcttttatttttgttttatttttatagattcggggatacatgtgcatgtttgttacatggatatattgtgcagtggtgaggtttgggcttctagtgtaccctcacctaaagggtgaacattgtacccaataggtaattttctaaccctcactccccgcccatcctcccttttttggagtcccaagggtctatcatttccatttttatgtccatgaatagccattgtttaactcccagttataagtgagaacatgtggtatttgattttctgttactgagttagcttactttgaataatggcctacagctctatccatgttgctgcaaaaaacatgatttttttttaaggctctgtggtactctatggtgtatatataccacattttcttcatccaattattcattgatggacacttaggttgattccatgattttgctcttgtgtattgtgctgtgataaacacatgcatgcaggtgtctttttgatataatgatttatttttctttgggtagatacccagaagtgcattgatgaatcaaatggaagttctattaaaaatcgccatactgttttccagaggttgtgttaatttttattcccaccaacagtgtataagcattgccttttctccacattttcaccaatacctgttgttttttgactttttaataatagccattctgaatggtatgagatcgtatttcattgtggtcttaatttgcatttctctgataattaataatgttgagcattttttcatctgtttgttgaccacttatacagcaccttttgagaaatgtctgttcatgtcctttgcccactttttaacaggaatttttgggtatttttttcttgttgatttgtttaagttccttgtagattctggatattagtcctttcttggatgcattgtttgcaaatattttctcccattctgtgtgttgtctgtttactctgttgattatttattttgctatgcagaagctttttagcttaattaagccaaatttgtctatttttgttgttgttgcatttgcttttgaggtcttggtcataaaatttcttgcctaggccaatgtcctgaagagttttttcctaggctgtcttctagtatttttatagtttctggtgttatatttaagtatttaatccatcttgagttaatttttgtatacagtgagggataggagtccagtttccttctacctatagctatccaatttacagaaactttttctaaagacatttgtatgtaaaaaatgggtataatatactacttgataaacaatgtctggtatcaccttctaatctgatctctgggaattggaatggaaagagaaggactagtcaactctcctaagactggttgttattgtttttgttgtttagcagcatattaaattaaataccaaccatggcatcagagaatatttcaccatcaacaaactgcaagtactatggcccatgtccaggaaacagtatcatccatcacttaccagattaaatggtttcataaagggtgatttctgctacattccaagagaaaaatatagcagtcagcacctatggtgacaataacccaattagaactatactagtgatagagtttctgtatttatttatttatttatttatttatttatttatttatttgagacagtctccttctgtcgcccaggctggagtgcggtggcaagatcttggctcactacaacctccacttcctggattcaaacgattctcctgcctcagcgtccagagtagctgggactataggcatatgccaccacgcccagctaatttttgtatttttagtagagacagggtttcaccatattggctagactggtcttgaattccggaccttgtgatctgcccgcctcaccctcccaaagtgctgggattacaggcgtgagccaccgtgcccagccctgtatcttttcttttcttttcttttctttcttttttaattgaaagggggaggtgagtaaagggtaaaatgcaaagaacaatgtatatcttcttcaaggagttttcaaacagtggttatttcctcattttacttttagttcatttgcagagcttagtgatagagagctgaggaaacaacagggcaatatggttaagtagcagttctgacaagcaaacacactcctttcgtctttgaagccaaataacagaaaatctgggagagagtggggaatgggttcaggcaaatggagagagaaaattattcttatttgaaatgtacatctaggcatgtttgtacaaactgcacccacggaccttctgtatctatgcaaggaatatattaattggtctcagtttcttaagacgcagagaagaacataagttttcatgtaagagtgaacagagtacctttttagtacatttgaacatatatttagcatcacaatgatgattttttaaaagccagaaacgttattagctctatcaactagcattgttcaaatatagcctttaaaatgttcatttctcatgtagtcaataaaggtaactgtgggtatccaggaacttatacatgaactgtgtaacagaacctgtctgagcctcagcctcctcatctgtaaaaatgaatatacaaatgcctgacttcctaattaggaaaatcaaactaacgtagtagaaagtgcctcatatactgtaaagcactacacaattaaaaggtaacattactatccctactaagtggccacttgcctttgcataaatatctccaaaataggtaattggcttattcctaagttattccactctacctcaaacaactactagaagattctttttgaaccaaaatctatcccttcttaactctgcccatttttctcaaatctaattttagggtctcacagaataagtaaaattccccttacaactgacagcccttcactattcttgagtcctctattctttgtgctaaatgtttccccaattccttcaacctgttcctcacattaatgggtttcaaatctcccttcctggtctctttctttagaacactccagtttgtccaaactgctcttgaaatgtaatgttcaaggctgaatgcaggtgtgggttcttattagcctctctggttgcaagaagccagagacattcaggttgcctcgagtaattgagaacatcttttcagtgtatgtgttgtcagtccccgggaacgcgggaaactctggtcaatccccaaaggaaaggcaaagactgtggatctctagcattaataagactcagcagttctctgcatttttgctcctctctgtctgtttctttgtccaatagcttattctttccatcagctcaatatttattttgtctaccacatagtttctactatctcataacgatgtcttttctccactgtaccacatgactccaagagtacctcctcacacctctcacctcatcccttcagctgcatgtcccattgctaactgcattattatcttggtcactgtaggctcaaaaccctaagagggaatttgattagcccagttcatcccttttatagcaggctgtgtttcagttttttggcaagccctggcaattattctcatagtcaactgaggctacggggagagaaaagtcatgtgattaaaataaacaacatggccatctatggttgtcccttgaggaaggaccgtgagcagatttgatgttccttagatgggactctcagcagtcagtcattttgactgattcactgaggattttatgctatgaccaacaattagccacctctcttgttctaattatgtattttcgttaatgctgtctactccagtatcagcttttttggtggccacatgacactatccatacacattgagaacaccggaaactaaaccccaaagcctgtttaacatgttctgaagctaaaccacgttttatttattctgtaagtacatagttgattctttttcagttttgtgtttggtatggaagataacagtggaaatatatttggagccttgatttggcctaatttgatctcatcttgttagcatgtggaaatgttgctgagttctaattctaccatacaaactatttgcttttgctctcagaattatgtcatctgtaggcttgttaggtatgcttccctcttttttatgtaagttatcgatacaaatgttacataagaccagattagggttagatctctgtgcatgccactggtgacatttatctattaggcaacattcttttactaacaacccacatttctccatcttgttcatagccatattatgggagaccttgttaaatgccttgctgatattcagatatagtatgcttacattcttaccgatcttccaatctaataaccatgtcaagaatagaaatgaaatgagattgtctaacataacttgttcttagagaatttatactgcttgctttcttatggttactacttttttcctaagcgctcacaaactgttcttttattaacctgttgtagaattttgtatttaatcaacctgtttcttggtctagtctaaggagtccatatgcttcctgtttattttgaaaactaaagccaatgttttctgtttctagtctcctgtcacacttcaaccacactacagttgctaaaactttagcaactgtgacagggtaatccaatctccaagacctctgaccactctgggatagaattttaattcatttattatagaacagccaaatgccttttaatgactgctttgcctattttagcttcaatttatggttactgatattgattttaccatttcaagtctatcatcattctttttcacaaagaaaactagtacagtagttgagaaggcctctcagatattggccatccaataacaatttcatgggttgcatgtctctcctacccttgctcttcttggtttaaatatattttttaaaaagcacttttctgtcatctttagcagtttttttctcaagcctcaggctcatttggggtataattcttcttagcattattttcatcatgccctcttaaacttacttatttttggttttcatccctttattttggcacctgttcttttgaaatccaaactgaatgtgaatggataacacccagtacagacacactggtttcaacaggttaaaaaaaataaaatataataacttcccaactctcttaattcatctccatattagagtatctcagggcatgaaattgtacctactttacttcagcaagctcttttcctaaagtctgggatttgggccttataaggtacttatggactctaagataaaatacttcacttcctctaaaggttcctatcaccttcaactcaccagtttctctttttctaagtcagtcagagaggcaagtttcttattttctctaccttttgggaggtgtagtcattaacacaaaaatttgggaacttgccatatatttgcattttgcaaatcgatacaactagcagatgtttatggagttgaaatcactcatgtttactaccctttcctcctacgacgcttttgtgatctgtgttgaaaatcagcatccgttgtctccttctggccaagtgtcttattatagactctccaatccactacctattagtcatgtgacattgggcacattaattatcatcaccatgtctcggttttctcatctgtaaagtaaggataatagtaaaacctagctcataaggccattgtgagcattaaatgagttcctaattgcaatgtgcttagagcagccatgaacataatgagcactccgtaaatattagtaataataatagcaataataacacaagagattattttactttttgtccctattgctatctttatctaactaaaggtatttctacccttccattcataatttcctcaaagtaaacatatacaacatcattccacttcctctcttagcatgcttttaaatagaatacacttggcctggcccggtggctcacacctgtaatcccaacactttgggaggctgaggcgggtggatcacctgaggtcaggagttccggaccagcctggccaacatggtgacaccccatctctactacaactacaataattagccaggtgtggtggcaggtccctgtaatcccagctactcaggaggctgagtcaggagaatcgcttgaaccggcggggagtggggatggttcagaggttgcagtgagccgagatcgcgccactgcactccagcctgggcaacagagggagattctgtctctaaataaataaatagaatatactctttcaccaccatgttccaaatcatcagaaccatcccccttctcccacattttgacgatacatacctgtgaggctttttaagactgccctgtgatcaatcttcaaaacagcttgtgcattgctgcctgccttctgtgttattcagaaaaacaatgccctgtctacccagtacattggggattgggccctgccctgagccctcccttactcagacgtcagccttgctatctccttctccaagccttcttctcaaaattcccaatgtctagattatattttgggggcagggtgttttttgcaacccggaaagatgggcacattgccaaagatggagaggctgggtgatgtgtgcaagcatatgtactccaacatccctggactaaactacttatgttattgtgaacttagacacatgacataacttccatagacctgaatttccctgtttgttttgtgtcaaaaatgacagaccctacctcatggggctgttttcagaactgaatgagataatatatgaaaatgtctactcagagccaggcacatagaaagtgtgcaataaatattactattttcaattcagtataatagcctggcacagacctgctggcaagtagatgaattcagagttactacaattcagagagacacaatagctttaatctgctgtaaaaacatccagtattcacatatacttcccagtctatggattattgtgcgtgtcctgcacagcgaggcattcagcaagcatttactagttattcctggtgcactgccgcttctatgaggaatgagaatccctgtattccagaaatgcatggtttagtactagtaacaataacgatatctaactatgctaaacagcattactatatgccaagcactattctaagcccttatgaatcaacttctttaatccatatgctagtgcccatgtggtacgtactatttagtgttgccatcctcaattgagagatgaagcaactgaggtacagagaggttaaggaactttgtaaaatcccacaggtaggatatgacagatccaggtcaggttttgaacctaggctgtaggtctagcatcttcatatttaaccactatgcattactgactttctgtagtaggggaagcaaaggtaaataaataacagtaccatcacaagtgttttgttatatttaagtaatccaaaggtaagaacccttggaggggggtagatctaaccaaggtaggaatagtagagactaaggaagtgttcaggtaggtagaaggggggaaagtcgaaatttccctgagaaaatggcctaaaaatcattttgttctaaaatcatgaggtgatactaagtgaaaaatggaggaaagggcattctgggaataacatatcacaatcaaaattgtgcatagtcaccagttatctaagtgatattaggcactattctttttattatttctttcccttcttcatttgccatttaaatactcttgaccaggttggccactctgtgagcaagcatgttctttctagtactaatgagagacaaccattctggaactgaaaacctatcattctcaagctatgagccagaaatctaaatttcatgctaaaattcctgctgttaaacttccatattatccttccttatccagaggcccatccttagatatactagagtttgcagatcctttctttcttttattctttgattttttttttcttcagaaagtctctttttcttccctgtggcatgagcctcaatcccaaaggtatcatatggctttggtggcacagtcctgtgactgcttgataaaattctgtaagactggttaagagtttgcatttgctattattagtgagattaaatattttctaaaatgtttaaaacataaaaaaaaagaaaacaatagaactgagttcaaagtcccattctgcttcttattacctctatgagcttaggcaaattactgaacctttctgaatttcagttttttgaacttaaaaatgggttaatagcactcactttataaggttgttacaagtattatttcataccgcacatgaaatttgcaccctcattttagtttcctttcttctttctcttcttcccatgtccatcccctggcactggctttattcctttctagcttctcacaatcatgatttactgctttccttcttttctatagaatgtttttttcattctatccatgaaattatgtgcaagtagattgacctgcctttaacacccaattaattgaagaggtgcttatttctgtcaggaattcaaacacagcccccttgctgcagagcactggaatagttccctttgcttctcagcctcttcatccaggttcacttttaagtggaattgcagccatttttgtttactcttatttactctctttgctgtcccccaattcaaattcctaattcagagtctacttgatattctattactcatgataatttttggccaagtgttggttcaagacaactaattttgcttggcctgatcttagatggtaattattttttcagaatgatgataatggatagtaatcatgatctatttaccaaaatgaatcttactcaaaggttttgctgtgattatcaacactagagaaaacctggtgttgggattaacatgaccacttcagttcacaaagacaaatcagaattgtgtggaggaatcatgccggggcaggagagtgcaagtaaccatcttcattgatttttagcatattctgacagatggctgcagcttggtatgaggctaactgcccttgatggctttaggccaatgtgacaattaaatggagtctacagggttatttttacaaaagaagagccagggccattggcaaaggagattttggcaaggaatggaaacagaaatgaaacttatatgaccaatgtgtattactatacttccagagctagtttctatcttggggaaaaaagaatcatttggaggaaatactcattaatggtgattgcagtaatttatttatggaaaaataccctttaagtattaaccaataaatgtaagttctccagcagcagtaatatgtctttattatacagcactgctaaaatatacctaacatttataagtagtttttttctagaacatttgcaatggaaaaatagagactaaattttttccttcaataatgactggagaaaaaaaatctcaaaatgtacatatgcagtgcttagatccaacagtatctcaggctttaatcctttaacagcacggaggttagcaaaaatctatcttcagccacagatttaaagattctttttaagacaggaaaagacgctgtagaactaatctatgacctataaatcctgtttaaccaagctcaaccaagcttttcagcctacaccacatgatgggtgtggaatatgttaaatttacatcaaagagaatgctgtagtcttaaaatatgttttacatgttgagagtaaaatataagtctattgtgcttaggcagtgaagaacaatactttggagatcagtgtgatacagtctctagttactttggtggcagcattatttttaaacatgcttttcaactgactattctcagtttcatttcaaaataaaaccataggcaaacataatttgtttcattttatagggaaagaatgcttcaccataggtgagatgaaatctgattttaatatggagaagatttacttggcaatgcaaatgtgaatctaaaaatgttttagggaatttttaaaaatgagttgattgatgtaatatacgagtatagcaaacaaaaattaaattttagtgaaatctctgtacccatcattttgccctccctcaccatatacttatacacttccctataccgactatatttaaaacagagatgtatggttttgaacaagagagaacacaagttcttaacaacttcattcactgcaaagttacttatccagtgaatcataacaaatatttccattaccatgtcaagttaatagatacttgtctattttactaagagcatgaaatatatttaaagcagcagaaaataaatttcctgtcaattattcttattttctatcagggtgttaatgtgtatctgcacgtgtgtgtgtgtatgtgtgtatcaaaaagatgtgctactaagcatctccctttagaagaatccagctggttctgtattaactccataacacaaaaatgtttgtagctttcaaagcaaaagataagatctggttaagtcttgaggtctttgaaatatgtttgcaagaattgtgaaagtgtggtactgagtattttatttaaagaacaagaaagctcaaaaagaattgtcccctttggtgaacagataagcaaataaacagtaacatctgcttctctattttgtttaaaaaattggtgtgatatctgagggtattagaaagtatataatgcaaatactttaaatgaaaaacagttcattataaataatataatgaatttattttagtttcatcaaattttaacaaatacttattaagtgcctaccttaaaccaaacactcttctagttgctggggctacaacagagaacaaaacaaataaaaaccttgcctttaatgagcttacaatctagtagggggagagagcctttcccctaaaacattgatcttttttgaggttaataatattgcaagacttggggtctggctagatgggatatgggaaaacggggagaggagtcaaagatacctcttaggagtcttcctagtctgccatcacctctgttttagactgggtaatttataaacaacataaattgattgctgtcatttctagaggctgggaagtccaagatcaaggtgtcagcagattttggtgtctggtaagcacctgttcttcatatacagcacgttattgctttgtcctcatatgtcagaaggggccaacaggctcctgaagcctcttttataaggacactaattccactcatgaagacagaaccctcatggcctaatcaccctgccaaaagccctactttttaacatcaacatattggggattcgatttcaacatatgatttcttttttgagacaggatcttgccctgccacccgggctggagtgcagtggcacaatcatgacccactgcatcctcaacctcccgggctcaagggatcctcccacctcagcctgtggagtagctgggaccacaggtgcatgccaccatgctcagctaatgtttgtattttctgtagatatggggttttgccatgtttctcaggctagtctggaactcctgaactcaagcaatctgcttgtcttggcctcccaaagtgctgggattacaggcgtgagccaccacacatggccaacatatgaattttgaagggacacaaacattcagactatagcaacctccccacttcaactttcatgtagaaaccccttatctatgatctcataacactctgccaatatgtttatcacaacgccttatttcattgtatatttgccctcaaaaacttctatttacttgtctttgttcctcactgaaacttaagtaaagtgctatgccttttcttatgttgatccctcagtgcttggctcatatcgttcaacaaaatgcatggacagagtaagtgagcagagaactacagatagagtagatttctgaaatcaggaacagaagttaatggaagcagacagtgcatattattttggaaatattggaacacctacgtgagccatctagtttgaaatgttcagtatcaaaaaaagttgaaaatatggatctgagtccaaggaaaggaataaatagagaaaaaatattctcctactacttgcttactatgtgccaagtatttttccaagtaactgtcacatttattttaacttagtgttattaaaactaaggcttaaaaatgttgaacaacatgccacagggtcatcagttacgtgtagtggagtcagttaaaacccagcttcggccgggcatggttgctcatgcctataatcccagcactttgggaggctgaggcgggcggatcacaaggtcaagagatcaagaccatcctggccaatatggtgaaaccccgtctctactaaaaatacaaaaattagctaggcgtggtggcacacgcctgtattcccagctactccggaggctgaggctggagaatcgctggaacccgggaggcggaagttgcagtgagctgagatcatgctgctgcactccagcctaatgacagagtgagactccgtcaaaaaaaaaaaaaaaaaacaaaaaaaaaaacccaccagatatgtctgcttccagagctcatgatggacgtagataattaagactttcataggtaaatgtaataatagtaagtattgaaaaacctagatggagttttatgcaagactaaaagaaagccaaaaaccaaaccatggcaacacttatgtattaggagttcatagaggagaaaggccagcgtaggtgactgaaaagtaatcacggaagagaacaaacagaaggaaatttccaggaggtggtgatcatgattttcaaatatcacagaggaatcaaataaactatggatgagaagagaccattgactctatcaattataaattttaagcagccaatttctgtacagtagtgagattgaagccacataccacgttggatttgaagaattggtaagagctaagaaaatggaaacaaaaggtaaagtagggttttgaaatggggcagtagattgagagcagactgaatcagggcaaaactttcatgtgaattggaaggcaaaatacaagggaaactacattagtgaggaggtatacactagacatcaggatagtgctgtgagtgacaagaagaaacagacccagtcagagatcaagttgccttaatgataaagtatatagaaatatgcagtgataatcacataattcagaagaaaacaacatgatcccatacaacagtacaggcttcccaggttgccaagtcccaacaaggacatagagcttcggaatttttttttttttttttttttttttgagacggagtctctctctgtcgcccaggctggagtgcagtggcatgatctcggctcactgcaagctccgcctcccgggttcaagccattctcctacctcagcctcccaagtagctgggactacaggcacctgccaccacacctggctaattttttgtatttttagtagggacagggtttcaccatgttagccaggatggtctcgatctcctgacctcgtgatccgcccgcttcggccttccaaagtgctgggattacaggcgtgagccaccacgcctggccgagctggggatttattaatcctcacctttgggaggaggattaaaataaaataaaaagtttgcctttggtattctcacagtagaggtgatattacatcttcccactcttatctaaagttggttctcaaatatacatcatatttccgagggcaagcacctatcactggccaagacacaattagaactcgaactttttatctctatctggcatacaaaaaacactaggcggtcccttgttactgaagaagatacttaatagtgacatatgtatgcacagagcttgcattgacagcatagatgctaacatgactatttccaattcaaactatcaaaatatcaagtacaacatgatattagcttcataagtaaattgaatttcttctggcataaaatagtcacaatctgatatttttctcacctttcaactaaaatcattgtttttatctatgacagtctaatctttcaaattttgtcatttaccatagtgaatagtatcattaacttaggtaattttatggtaatgtgggtagttgtgttttagtagatacacttgtagctaaatactttttcttgtctgtcaaaatcaaaaggcttagctatttgataatgtactgtatatgtatgcatgtatgtttgtgtgcgtgcatataggcatgtgtacatatataagtatgcacgcataatttgctattgtccaaagtattttcactagttatctcatttcaaactgtaaaccctggaaagtagacataatagaaactatgcccaatttaatggtaaaataactgagtcttgggaaattttaataacacattcatgtggagcatgtgttattaaattattaaaatttcttggagcaagatttggtgttggaatgtaagtcctgtgcaaacaatccaatgctctttgcactataacaatttgtctctggtatataaagaactccacgccatctctttttgtctttcagtgaatatttatggttcggttaagtttccctgcctggagatataatctagtttttattctatttatattaaaatcttaaatgcccaggaaactggggcattctggttaattggatttggtggttagcttaaggttaaatagaactttttacaaattgccatccttgttgaaaatcattcttaaatatgaatctactttccatgttaatccaaatgatcataatttaatcttttataattgaaaatcttatagtacatcagggttgccatttaagcttgagttgttattgtaaagtgttctaggtataaagggatgttgtagagtggacaaaatgtctagtggtcccaggatatccgttgcaaatttttaatggccccgtgtgagtttttgaaaaagcactagatttacagttagaaatcttgagtccaagtccaatttcactattaaatagctatgtaaccttgatatccctttcttcttctcaacctcattttcctcaatagtcagatgaggaaatgaagctaaacgatattcgaggtcctttctggctttacaatctctgtcattctgtgacttgcttcttgtctcttgctcctccactgaaagaatcctgcttaattgagctttccagttagttggattctaattaattgcaagtttactaattccaggtgaggtccccaaacaagtgagatagatttaagttgagcagtcatgattctttctgaatttcctataggcaagaagaactgaagaagacaccacacttccctttctgtcaaagggtagtgatgatggcaggcaactatagttaaggaggcaacattaggccagtgcaagactagtctatgaagtcatttttcctgttacgcaataggtgcttgatacaattttgttaaataaatgcatttttaaaacaaaaccctttgtgaacccaaaatatctgagacacatctcagtcaatttaggaagtttattttgccaaggtcaaggatgcgctggtgacacagccttaggagaacctgacaacatgtgcccaaggtggttggggtgcagcttgcttttacacattttagggagacttaatacatcaatcaatacatgtatgatttacatcattggtttgatccggaggggtgggacaactcaaggtggggagcttccaggtcataggtagatttaaacattttctgtctggcaattagttgaaagaattattagtagaaaacaatgtctgggttacaataaggggttgtggagacttaggttttatcatgcagatgatgcctgctttagagaaaatagactgtatatgtttcttatcagacttaaggtctatgttgatgttaacactggagggatataacgaggcatgttaaactccatcttccatcatggcttgaattagattttcaggttaactctgaaatgcccttggccaagaggaggggtccattcggatgatttggggccttcgaattttatttttggtttgcacctttatagtgacaagattcaagatgcaacaccttgtatagaagtctactctgccttgggtcatactgtgtgtgaggctgcagtacagtttcaatatcttccttcatgttgtcattctcagtctatgacataaatacagcttcatattatgtttcctattgaaagataaaaatataatctggtttaggtttaagttacaaccagccatttctatactgcaccccgtgaatccgtgatgatatttgttttctaaggataggcaatgatgcatagaaaaaataagtccaggtttaatattatatttgccaagtacaaaagcatatttagaggtcagcagagtgcatgaaatccctatattcttgacgttgaccttaccttgtttatctctctgtgctgtccctgaataattaaagtgaaccaatgtgtttcttctttgcactctcaaatccacacagcagggaactagggagagaacattttagtggaaggcaggcctgctttccacaaattctcctgtgctcaagtggaattgtagtcactaagctttagagcatagcacaaagctgaatttgactgtttcttaagtgacctaacctaagaggagttaatgttgtttcaattgctatgattattatatattctgcatattttaatcagttcaggttttggatttttgcctcatgacaggttcatgaggggtacagtttaaaaagcaatttttttttattgttacaaagatttccttgtttggtcagtaagggtaaatgtttgaggcaattatcggtgagttgtatatgctctctggccctagggttcagggtatttgtttggataatagaccaatcccaagtgcaaatagagcatcaaggaggaacagctgtgagcttggggaggaagataagatcaggagtgcctggcatgaaaatcttcctctgggagtctttacagagtgacagattttctcctgtagagatgtagaatacctcaaaacttcacgttccaattggatgaagagtttagacaaatggttctcaacttcaccactattgacattttgggctgaataatttcttgttacatatgtcttaaggaggtagactgtcaggatgtttagcagcgtatctgacctctacccactagatgccagtagtacccctccccaagttgtgataaccaaaaatgtctactgacattgccaaatattccccatggaccagttggtcccctgttgagaaacactttttttgtagccagtttgagaaacattcttttccatcgatgtttcccaacttagtcctggtactggtaagacaaaatctattgttgctggatcactttttactcaaaccactcttcaaactcttaatttcttttttcccttcccatctttccctcctcctattcctttcttccaaggcctttgttagaggtttagacaattctccagtttatagtttgggatagaaaccattaaactacatccatttaaatctgagcctctctgcattgctttacttttaatgcaatggcaactcgtcatataatttttatccccaattaacttgtcatatcctgcatttctatgtgagagtcttaagcaagagaaatacatttttgacacattgaatatataccctgtttgtactatacttaattgacttgttttctggtaatgcataaagatggaaaaatacagtgtgtcattgctgactatttatttagatcaaaactaaacaacctatagcaaaggagaccagagtgacccctgaagcaactaacgaatgatcttctaaccttgcaaagacagccatatctatctgtaagatttcttttcttactctattcctttctcttctcttatactcttcattctccctatgttcactttttgtcctctatttcctgccttactttagacctgcactatttgggggcatgtcttagctcttctgatattgttctttgcaaaaagcttacaaggacacagaaacctgaaagaaaaatggcccatttggagatgcacataacataggatggctagaagtatagagggcattgtagacaatagcagtagtgaggctgacaggcctgcagaggccaggtcatgacggaccttataaaagtagtataccttcatttcaaaaatagaaagtacatggataatcaccaggaaaaataactacaatttccatcatccaaagatacttactattaagatttccttttgttttcttctagatcagatgtctgtggaatggggatttggggttgtattttgcttttggttttgtgtgggaggggacagcacgtaattgtggttgtactatatgcatgaactctgtttcttgctcaatatggaaaattatctagttactgggagcagaaaacctgtacaactaaattaaactttttaaaggttttttttaagatgcagagtaatctcacagtgaaagaaaagcacagtaagtacagccaggcctaatgaaagatgaaactctctccatcattctatttctttctgggaccaggtgatgtctcatcttttcttctctctagagatatgctccattctcaagcttcactctagatgggatttctttgtctgttcccctataatgttgtaactccagctctggctcaacatgaccttgcatcttggcttccccagttgtgtgtctatgtctagatttctgagtgagaaagagagaatacgattgcctctaagtttggttatccaattctggactatggctgcaggcagtggggagtgggcatagggggatcatggatgtcctgtctaggtctctgtgctgagagacaatgatctacatatctaatatgcttatgtggttaccaattctttggattttctgactgcataatattccatggaatgaatgtgttaccagtagaagagatctgagttaccctgaccagcagcatatccatatgggtccgtagcaacttcagtccctgcctcctcagaagaaagaatttaactgaggggcataaagcagaaaaagagactgaggcaagtttcagagcaggagtggaagtttattttaaaagtcttcaggacggaaagaaaggaaaatttgcttggaggagactcaagggggcacctgaaggtccaagggagaaaagagagcaaaaaaaaaggtgcctttaactttgatcctagggctttataggctcgtctctcccatgattctacccttagggtgggcttcctgcatactcagtgcgttccttaccatttggaattgagcacgcacagtgtgtttagggagttatacacatgcccatctgaggctttctttccttttccagtggcgtgtacccggaagatcatacttcgctatttttgtctcttgatgtgcatgtccaggaagttgcttctccttggggcctacattcaattaacattttgatgttaacaggtgtggactatcaggaaatggcaccggctaccaatttgtcactgtttgaaaggcaatgcaataattgctgaaccatcaatggacatttctagtgggtgatagggagagccctctcctgccccactcatgcctatttacctgtaacaattgtactaggctccttccatatttgggtctgcttttttctagccagtggatgaggaaggagattggggatcatgggtggaaagttttaggggtcaagccttgaagtgtcagacatcacttttgctcacactttacatttcattagccagaactcagtcgcaggaccacacctaacaaaaatggtggttgggaaattgtactccatttgtgtgcccaggaagagaggagaacatgggtgttggtgagaagcagtctctgcttctggctgttttattttgaggctatttcaaaggacattcatgtgttttgccagcttgttctttagagaagaaaaatgttatgctggatagattaagggactgatttgagtggcatttcttatgttaatttatgacattataaaatattcttacctttaatgtacatgtatgaataagtctttcaaagaaataaaagctgataaaagccaaatgttgatcaagatccttcaaaagttgcattagcataatgatctagattttcaacctgaagtgtttagtgagaaactcttaggctctgtccttcttgtacttctttgtaattaatttgaaacttttttttatataagatgtccttatcgaggtacattataactcaataaaaataaatgatacagaaaagtataccatgtcaactggctcataaaataaaccaggaaaagacatgtctgtggaaaatgaagttgaacgggagtctgaggcaggagaaacgcttgaacccgggaggtggaggttgcagtgagccgagatcacgcctttgcaccgagcctgggcaacaagagtgaaaactgtgtctcaaaaagaaagaaagaagaaagaaaagaaaagaaaaggaaaagaaaagaaaaggaaaaaaaaagaaaagagaagatgaaaaaagaggtaataaaagtgtataatactctgcccactaccccctcctgtataaagaaaaaaataaccataataatccaagtaaccactgaagatcaattttataaaatcatcagtttctctgttgagtaaaattgggaactgactttcagcaaagggaaatgtaattgagtttctttacaaaatgaagagttttttttttttttaagtcctaggaaatttagagtctgatttacttttaaatgtatagtcacaagtatttcctgcgtcacctgtttgttcctattttgattagtctctgttagggaatgaactactgaaaactatagggtggcattccattattcctccatagggaaaatgtataaaattgtaagaggattgataagctcacctaccaatagctttccacattattttgtagtttgaaaggattatagcttccacaccattatctcaaaacctaaattagcattaaatataaagagaatgaaaatatgataagcttacttatctaagtaaataatttttatacgttggcctgagccttttaatacaggaacatttgcattaatagaaaatattaatttggtatttactcttcaactgatatagagttttttaatatcaaattttaaattaaagttgggttaacagaacatggatctaacttggggaaggagaatgaaagggtgacttgaaagggcattattatgaagagaagcattaattatttattttaattagttttgaggtctactaaagcaacttgatcaaacattgtaaaatatgtagtatattctttctataccatttatgtatctatgcccttactcctactttcaatttatctctaaacatcctgttaaagaatgttgaatttatatttagttatatttaatttatatttatgtttatattaattgacatgggaaagtccagtacagtactgcatgaaacttttctgatgtcccccacattctaagcagggagccatgacaattacctcactttcacaatgatgataagtatcctcctgatatcatttgatcatttctgtaattttaagagttgaaaacaaattccataaaaacatattcagtgaaatatgaagtttatatgtattcatctttgagaagagaaatatcagatgaccaggtgaattaagaagatcatactacctcaatgattaatattatgagtgatattgtaggcatggattttaaaatattattgagtgcctgctgtttattatgcaccattttaagcactgaagatacagtaataaataagataggcatttgtactttcatgtagcttacattctagcaatcaacaaaactgaagttgattaccaactctgccttttaccaattgtgtaacctgatgaaatgtatctaatcctattatctgacccacagcctcctcacctatgaaatgcagataatatcatctaccttataggattatggtgaggattcagtgagaaaaagcacatgaagtactttagcagagtacctggcacataatagatgttcagtaagtggacaatgatgttgccattatcattaacagcaattatctttaaattattagtataattattaatagtaattctttcatgactaaaatatctcacaagaagacatgaaatgtgaatcaactatttctttgatttatttattttagattatgtgaaaatgaaatgagcgcatatagttgtttttacattcaacaagccaagaaatatttgcccgcaaatagaacacttaccttagactacccaacctttgttccttctgcatagtgattcaagacccatttagaagaaacaaaggcatcatacaaatcaatatgtattcatcgaatacctctgaagtaagagacaatgtacctagaaattaagactgtttcctgtcctcaaggaatatgcaatccagagatagttgaccagatagggcagatattgcttctgaataaaagaggagaagggatgataaccactgaaaggtttaaaaaggatctcccggctgggcatggtggctcacgcctgtaatcccagcactttgggaggccgaagcaggcagatcacctgagggtgggagttcgagaacagcctgaccaacatggagaaaccccatctccaccaaaaatacaaaattagccgggcatggtgccacatgcctgtaatcccagctactggggaggctgaggcaggagaattgcttgaacccaggaggcggaggttgcagtgagccgagatcacgccattacactccagcctgggcaacaagagcaaaactccatctcaaaaaaaaaaaaaattttttttgcaaatcacgatagtaacgatctagactacagagtatttctatttgagaatatattatagaactaagacttaagcctaggaaaattaaagcttagataggtatccagaaattcatttaaaagctcttaaaattatgaacgatgtggacggagcatggaatttttatcaacacttggcgtccgaggtttagaagcaatatgtggacagaggtggcttagtatttggaagaaagaatcacagggcaaataaaatgaaattctcctttatatagttgttagtagagatgttgaggttgatatctttgccagtaatgactcttttccacaaaacaactctaagtattcttgttagagaagaaaatggggctgacccagcatggcattttcttgtgttttttggaggcatgagaataaatacctatgaatagccatttaagcaaaagtgatatacaaatgccaaaaagcatatgaaaagatgttcaagggcgggtgcggtgtctcacgcctgtcatcccaacactttgggaggccgaggtgggcagatcacttgaggtcaggagttcaagaccaccctggccaacatggtgaaaccccgtctctactaaaaatacaaaaattagctgggcatggtggcaagcgcctgtagtcccagctactcaggagtctgaagcaggagaatcacctgaacgtgggaggcagaggttgcagtgaaccgagattgtgccactgcactccagcctgggtgacagaacaaaactctgtctccaaaaaaacaaaaaagaaaaagaaaagaaaagaaaagatgttcaaaatccctattcatcagagacatgcaaatcaaaaccacaatgagatatcacctcacacccatgagaatcattactattaaaaaaaaagaagaaggaaaattacaagtattggtgaggatgtggagaaattggaacccttgtacatggttggtggtgttgtaaagtagaaaccgctatggaaaacggtatggaagttcctccgaaaagtaaaaatagaactactgtatgatccagcaatcctacttctaggtatttatccaaaataaatgaaagcagatctcaaagagatatttgcacaccttctatgtttacagaagcactattcacaatagccaacaggtggaagcaacctaagtgtccatcagtggatgaatagataaacaaaatatggtacatacatacaaaagaatattatttggcctaaaaatgagggaaatcctgtcaaatgctacaacatggatgaacttggaggacgttatgttaagtgaaataaatcacaaaaacacaaatactgtatgattccccttatatgaagtatgtaaagtagtcaaaatcatagaaacaaatagaatggtggttgcttggaagaggatggaaagaacaattgtttaatggggatatagtgtttcagatttgcaaggtgtaaaagttccagagatctgttctataaccatgtcaataatacttaacattactgaactatacactaaaaaaatttaacatgcgaaattttatgccatatgctttttatcacaataaaaattcattttataatttgtttttttaaaaaaatacctaaattctactatgctatccaaatatggtttggtcctattaacttctagtcttcttgtttttaaaaacccaacctcagcttctactggaagcaagttgaattccttcttctgggtacaaaaatgagtcagatgcttatagctaagggaatataggtatagatatgcgtctcataagaatgtttacaagatgtaaaagaaaaaaatcattggttatttatgcatctgttgttagaaagtcatagatttctgtctgtttcctatagaattttaagtgccacattaaatcacattatttagtgctagcagataccctcagaattatgtagtatgaggggtttaaaaatagagagcacattttccccttttttatagatgattttaaaatccttacaggggcatttattatattcccatttaccaccactgggtctcatcattcttgaagattttttttttaatttctttatatgcccatttccttttggtaatatcttgcctttcctttttaaatttgaacttgaatattaaaacagatgcaaagaagagtactacttacacataaactcttgaactgcatttttatcatttgctctgtggaaaaaaacccaattgtatgaaattgatagcaacattttagtatatcctcaggtccccagggaaaagcaatgtgcttagacagatgatctgattgtatgagcacatagctaacatctagcactgagcatttgtctttctgctcctgcttctttcagggactatgaaaacacatttaggcactagtttgactttccaacaatggactgcaaagcctatgacaaaacacgtcatttgcattgctctttttcatggttcacaacaaagtacagatcactttcagcatagaatcttaatctgagtttgttaataagaaaacaagaaccttagtacatgaactcattttattatctaccctcattgagaaccgtgatttggattccactcaaataaaaattagtttaaatgttgttctgctgcaactgttgaatttattcattatgctgtaatattttacttatgaaactgcatttggaaatcctttggtgtacatcaggatgaaattacagggctcagggatattgattattcttgtaattgccgtcataatagccaacaattctctgtcttttgttttccttccttccacctcttaatattataccaaaccaaatcaatatccaacatattggaacacttacattgtctcaaaaatccaattattctccttcataaatgtgcaaaagattgaagattttatctccaaacattaagtaaaggaacctcattctgctgggtttctcctttgtcccataggaccatatcagagtgttgctgcatcgaatccataatatgtgacattttgtcacctccaaagtaaccacagggcaggagtggggaggtagggaggctacatccctacgctgcctgtatagtgctacacttcttgctcactagtaaatgaaatggtcaaaggggaaaaaaacagtctgggagagttaagcagacattaaaaaagaaattcatctttttatggtgcggaggaggttatttatttaaaagccttaaagtaacagcacaatcaaatgaaaagaggacaactaagagtcacttattcattaaaatatacttaatcttattattatttttatattgtttcttcattctggggataaattaggtgcctttagaagcagtagtaactcttttaggttttcatcaactaaagggtagtttctttgtaatgcttacccattcatccaaaatagttaagacagtctttaaaatttactagaagaacatttgacatacagaagaatagatgtgtattatgtagtactgtttgaacagatagtatttgttgggcccaggtcagttaacccagatgattagaacctgatgctaatctggtgaagactgtggttgtcaagtagcatggggtaatgtaaatacactattttggaagccccagatttcagtttcatccatgcctattagctagctatgttatttttaagtaagaaagtttcattctcttggcctcagtttccctaacgtcaaaatgagagggatgggctactagatgatttctgcgggtcccttccaactctgtgattctgtagccatcattctcacattcttgttattagtcagaaaaggaatgtaatagtgtggctcagttaaacatcatcctcatgccaaattcaacacaaagcatacttattctatgcctcaacaggcctgtattcccatcacaaacaatacactatgttatagtatattgtttaagagcagtggctctgcagccagactgcctgggtttgaaactcagtttaatcaattactagctgtggggccaaggaaaagtgacttaacctctctgtgcttagatcgtctcatctgtaaaatagagatatcgactgtaataaagttgttatgaagattaaataatataatactttgtgaagtatttagagcaatgcctgtcaaaaataatcactcaaatgttatctcttactaacattattataataattactattatcaccgctctactcctactaaacctctttgggtctcagttcagtcatctagaagattaggataatagtatcaacttcacagacatataaggatcaaaattggagacaaagtgcctaacttggagcctggcccatctaggcgctcaataaatcacgttaacttaaatggaaccaactattcctgtggttggtgttatcctgtaaatgttttccactccctaatactcatgaatctttttttttatcttagttacaaaatcaatacaagctcaaggcagaaaagttcagaaaatacccctaccatacaaaggtaacataaattattattttccttgaacatatgtactttttttcctttaaaaattgaataacgttgcccatactcttttgaagcctgcctttttttgcttggtaatatctgtaaacacttttcccagtgaatagacagtcatttgccacgcaatttgtaatgattgtgtagtactacattatgtgtttataaaataatttacttaatgaaatagcaattactgggcatttagatgtttattttttgctattataaataacattgcaatgaatggcttcttatatggattgtcatacacatcatttcctgaggaaaaattcctatagccataattattgcatcaaagaataggcatttttaaagtcatttgatacataatgccaaattgccctccagaaagacctgtgaatctgtactcccctcagcaacccagtcctttaaaaaatttttaacctcatgatactgaagcaaaattctctgttgtgggtattttccattaacattcatatagggtttttttaatccctttaaatacatatgcttttgttctttaaatatggaagctagaagtcagtcttaaaataatgttagtaatttatgcatttgtgcacacattacatgtacaaggtgatgttggctttatgcttagtgaaattttttgttgtacattaaaatgtagcactcgaatgtgttttgttattttactgccccaggtaatacggtagactgcttaagattaaagactttggtcaaggtgatgaatatgctaattatcctgatctgctcattctacatgtatatgtattgaaacaacactatgtgatgctggtaggctgggggaagtccccaaatgctggcgggatcttggccacagctggtgtccaggctcttgacactgttgcaagaatgaactcaaagacaagttggaaaatagtggaagtatggacatttattgcaaagggaaatgtacacactcaagaaaagggagtataagtgtactcaagagagaatcacccacaagggggtttggagctgctaccttttggggtttgtttattcaaggggtagaatattcatgaaaattcctgtaaaaaggtggagatttatcggaactgtggtgccacccatttttacaccaaacatgggtatttctggaactgtcatggtgctggtgggttgcgtgatttagtatgttaatgaggatataatgaagtccgaggtgaaacctaggtcaaatcccgcaccacgttgggtccagtcagtcttagccagcttggttcaaatcctattattcagggtcttaatagcccatagcctctaatcatgtgaaactgctgcctggaatttttttattctcctgcaaccacactatattattcctgtctcatatgtaccccataaatatgcacaattgttatatatgtcaattaaagataaaaaagaaaagaaaaaagtttataaaaaatgattggccaggcacagtggctcatgcctgtaatcctagcactttaggaggctgaggtaggcggattgcctgagctcaggagttcaagaccagcctgggcaacatggtgaaaccccgtctctactaaaatacaaaaaattagccaggcagggcggcagcctgtggtctcagctacttgcgaggctgaggcaggagaattgcttgaacccaggaggtggaagttacagtgagctggagttacaggctggagtgcagtgagatctggaagttacaggctggagtgcagtgaatgagatcgtgccactgtactacagcctgggtgacagcgagactccgtctcaaaaaaaaaaaaaaaaaaaaagattaaggactttggaaccccaaatgacctagattctgattctggctctgtccttcacttgctaggtgagtttgggcaagttgtttaacctcttttggtctccatttctataaatacacaatgagaataatatagactatttcataagagtaaagagcaaaagagatactaatgagtgttcagcacaacacttggcacttagcaagtataaaagtacttttatttatttgttgtataaaagaagtatatgcaattttatttatttatttatttgtttttggcaactccttccatgtgaatacattactactgtttacaaaatgcccatattacaatagtcatgaacactcaacaatcattctttagtaattcaaacatgacagtagcatgactccatttgcatgaagttctacaagaggcaaaacaaatgtatggtggcaaaaacatgcagaatagtggttttctctgggaatagaaatagggatttacctagaaaagacagaagagaacttcttgtcttgatgggaatgttatacatcttgataggggtttgggttgcataggtgacagcatttgtcaaatctacagcaaatgtgcacataaaactgcacattttattatgcataaattttacattaaaatttgtaaaactatcaaactagctaataatatgtgagttaaaatatatgaagggaagtgtactgatgtatgcaacatacttcaaaatgcttaaaaactaaaaactggccgggcacagcggctcacgcctgtaatcccagcactttgggaggctaggcgggcggaccactaggtcaagagatggataccatcctggccgacatggtgaaaccccatctctactaaaaatacaaaaagtagctgggcgtggtggtgcgaactgtagtcccagctactcaggaggctgaggtagaagaattgcttgaacccgggagatggaggttgcagtgagccgagatcatgccattgcactccatcctggtgacagagcgagattccatctcagaacaaaaccaaacaaacaaacaaacaaacagaaacagaaacaaaacaaaacaaaaaactaaaaactgacagatggagagaagaatggagaaatgaataagtatgtgacaaagtgagttcagtcaaatgctaactgtggaatctagttagtgagtatgtgattgtttattataaaattctttcaacttggctgtatatttgataatttttataataaaatgttgaatgaaaatatggctgtgaagctagtctctaaagtttggtagtgaggataatctcaaacactggtgtctaggccattctaatgatcaaaatgcctaatgatgcatctctgtttttgaatcaactcttgatgatcatatttaatgaaagggaagggtgtagtgtgtaacaccaaatgtggaatgttagcactcactagccagcaaatcggggaacacaaggcctgtttcttaaaggtctagatgaaaaaagaaaaaaaaagacaaagaaaagagagagaacaacaagggcaatttagaattatctcttaggtatatgaaaatgttgctgagctccatccagttctcttgagcttggctatagcatgattgtttgaaattaatggagtttgtgtttttgtagcaactggctttgctttttatagcccaaacttgtgtttccttttcacaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattggtaagtcctttttgtcatgcctcagttttgttcttaatcaaagtcttgttttgcttgtggtgggaatggggggtttttctctcgattctggcatgtacacatttggacctaggcttagtatgataacaaattgattttcttcttttttttttttcttcctaaccttaaatactgctgaggagagtaaggaatgctctttgagaagaaatatttatactactaacacagtcttattgatcgcaattactgtagttaaccattttcccttcaattaaaaggttgttatggttttcccattagaagtcataagtaccaatctacaatagcttcttaaattacagttaaacaataatactgctacggaattttcaggtagcaatttcattaaagccccagttatttggaagctatcagaaaattcagtacataatttcttcccaagaattcagatttttacactgtgaccaaaaaatgtattcttatttcactaggtaaatgactgcaaaattgtttagttactatgtcttgaaaagtaaagcagagagcagttataaggtgctctttccacttttaggaaaaatgttgttgttcttgagtcaccctgattaaagtcaccctcatttggtagcaaattgtattgatttttctggatgtcattttattgtgactgaatattaatttactttcttgagtggttctgcagtctaaaatgtaaactgacttaagaaatgtgtgtattttgtggcagcactattcctagaaggaatagaatgtcattgtagaaaacaaagtctatccaagtatatccctaataaattattttcaggtttaccccagttacctatttgaagcagatttacccactaagagacaatgaatatgattttgagtggcagataaaaagagacttagactttctttaagtaataaagtacatttggttgattcccatttatctaaaatgagaataatctaaaagttcacataatgagtttgtgtgggcatcatagaccagtggatggtaagtaaataaacggctatattttgtagggaggtcactgatgatgtaaacagtataggatcatagcctgcgctgatgttcatgattctctcttttatattttcatcacacaagctgaatatatttgaacaatgcttctatttaacatggattatattaccctataatatcaaaactgtgtcttttatctcagacatttcaggataacccaacatgtgtgtttatttggtttgtggtgacctgtaatgagaaatactgctgaaggaatggaggcgaaggatgagaaagttctacaactcaaacatgattttcatatatcattgagaacaaggaataatataaaaagtttaaatacattagagtccctttaaaatggtcttgctcaattgagataaacttttatatgggttattttctattaacttttactatatagagagataatgttttagatacaaggcctaacccttggtgtaaacaagctcaagtaatagcaagctctttatttaggtttataccatgtttaatactaattttctatttaaatttattattatggccactcccatatcaaaattttattacatattctgaaacttgtttaattcagttgtatgtttattcatttcatcagcaaaagtggaacatttcagttatttcaaggactgtcttttttaatagaataaacaatggcatatcaatttggcatggaagtaagacagtatagttcaatagttattaacatagatttttcagacctctgccacttattaggtgtgtttccttgggtgagttacttaaccttttcaggtctccatttcctcatctgtaaaacaggcttaaaatcgtacctatagcataggattgttagaagaattaaatgagttaatataagtaaagcacatggagtagtgcctgaaatatagtaagtagcctataaatgttaaatattatcattaatattaccattgttaccatcataattattattcacgattaaaattcactagttcccagaattaacaattttgttcatggctgtatctcagcaccaagaacagtgcctggcacgtgtaagccctttcagtaaaagtttgttggaaaaaaatgaattatgctaagctctttccttgtatgagcacatttaattctcacaacaatccttaaggataggtatcaatacatatgtattttataaatggggaaactgaggctcaacaaagttaagaggtcacatagaggccacttttgagattaagagggtgccttgctaagaaataaggatgctgagcttcaagccagagcagactgactcttgagtgctaggccttgctgctcttctagcactgaagtaaactttataacttgtttacttctcagtctactgaataaatccaccagatattttttcttattaaattacaaattcaattagatataccaagtcatctattcccatggtgagtgccactaagattggttgattggtaagcaatatttgttgaaatcatttactgggagattttttagatgcagaaatatcaggctaaatgctggcacagtaacttgagtgggttcaatatgagaagatgtttatggcaaacactggaactttgttcctggttctgtcatgaactgga

SEQ ID NO: 1133 - DNA, 502103 bp, mus musculus; identical to SEQ ID NO: 1132

SEQ ID NO: 1134 - DNA, 32250 bp, mus musculus
aggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctgggggaaccatcaggcctgacctcggtgccccaagtcagggataggacccaatttgacacatacccctcaagcttatacccccaactcttcccccacaatgtttctcatctaccttgctgtggtagctgcacctctccactgcccttaacgtgaacctgacagaccccatggggtctcctgctctctggagctgcagcccattgtgtgtgtgccctctcaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggtgagtgccacaccacgggtggctgctatggggctgggagagcatggtgcaggcaagggtagtcagagaacccaaaggaaggagccggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggtgaggggctgcagctgctacccttctgtgcttggggggccggagaagtggggtggaaaccagcactaggaatctgagcctacgtgtcccttctccaataggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgca

SEQ ID NO: 1135 - DNA, 5008 bp, mus musculus
aagggcccagagctctggccggcggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactgtatatctgtttttctcgagttttcttcttgcagtgctctttcaatctcattggacatattttatattattttcctgcttaagcactgggggttgggtggaaggatctgtggctcatcataggcaatttccacacttttaaggtttctgactcttcacataaacacctctcactatgatgaggtcctgtatcaagtacaattaatctttgtactttacaatttacatagtgatttttatttacattatcatatttaaacttaatcaaagtccttggcacggcccatggaacaagctccatttttttgataaagaaactgaggctagaaaagtttctatgtgtgcagagaaggaaggtgaaattattttaatgcttcaaagttatataatgcttcctgcctccctgtatttttctttccattgatcttccttcaaaaccctgataggtctatcccagttttgcaagtaagaaaacatgggctgtgatgtagagctaatacgttttggggtagtgggtcctcagacttaggtctgtctccaagggtcactgactttgttttgttttgtttgttttttgtcaacagattagtccttgtggcaccaagtcagaatttcattcaaaagacaattaggaagatggttttctatggaaaatatttaagtgtaggtcttaatgtgaaagaaagagggagagaaagaaacccctttattatgttctcccttccttaggcattttttgtcccgtgggaaaaaactgtactagggacagagacctctgttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaaggaaagattgggaaagatcccaccccgccaggagggaggcaaaagcctctgacgctcccctccccccatagctgaccaaggccagggccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtc

SEQ ID NO: 1136 - DNA, 2883 bp, mus musculus
cgtgaccaagagccgcctagagcacaagtcctgctagtcgcctccgtctgggtaccagccccctattactctgcaggcgtgtgaagaaagaaggaaactagctcggaccgtgcaggtcggtgcgagggtgggcgctgcttgagaggaggtatgggtggaagagggccaagaacgccacagatccgagttcaggccgatcacagctgggtccctttctcgcctactttctaaatactgctacccacccccaccccaccccgtgctcattttagtagagagaagtggcgggtttcgggtgggggtgaggggagtgaatggcgtttccagagactccgagaaaagaaaggttctagtgtcccgggtgctggtccgtccaccaagcactccgtcccctcggtcccttgtctgtttgcaggtttgtaggtctgttggcctgtaggtttcggcacaagtttcagcgagagaaggagaaaactgccttggttggaaccttgcaggtcagtgtgaaggtgggattagcccaggaccatgggtgggggtggcggaggaggggggctgggatatgagagggccaggtccgagtcgccctctcctggccccttctttctccacacccactcccatttcagtgcagggaaaggggtgtggcggcctttgctggggaaatggcggacgacaagtggggcggaggaggcctgcgtccggaaagtcagtagagtatgagaaatattttaaactcaagtgtctaaaattcacaaaaacagaaattgggacctgtgtcctcagttcatccactacactttcatttctccattgccgcctacctgtctttgcatttgtccttctgccagactctatcctctatcaccgtggagggaccactgacaacagaagacaagggaaaacgaaggaatttatctgactttggtagaggttaatgagagaaactgcccttaatctttgggggtggaggtctggtgtaggagactacctgagaggtactcacactgtcaccctcctagctatcatagcagagacccatctcctgcccttccctgtggacccaggaagagaaatgggggctcctgaggtcgatagaggaagacagaaaagaaaagaacaaagaaattgtatcctgttaatctgcctttatcaccaactcgaaatccaccctgtctgtgaggcacaaagccaaacatagtcccgagccctaatactctgtttcacccacagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcagaaaagag

SEQ ID NO: 1137 - DNA, 41312 bp, mus musculus
gggaggggagaaaccaagcgagtagacagagatgaggcaatcttttgaattggatgacggatagatgttggtaccatccgaccatttgggaagtccagaggggaggctttgttttccgggaatatgcttaatttgaggagtgggaaatggatagagggtaggtgaatggttagagatctgcacaaagctggaaggcccacgggatcaagttctgcccatgactgaggggtgacctccaatccctgggccttaacccccaggatccctggacctggaacgcccattaggtcccctcctttccggcgagagggcggcagagggcgcaggcgctctagccggacccggcgggcgggtggcagagggcgcaggcgccctggacagagcggccgcagtgggaacggccggcagggggcgcagcgctctggtccgagaagcccgggcggggcaccctcgccgggagagtagaggataggggtcggctggagaacgggcccagtgcgaggccgcgagcagtgggcggggccggggtgggggcggggcgaggcggttccggaaggaagtggttccgggtcccgcggcccggcagaggtggctggggtgtcgctgctgtgggaggcggcggcagagtgaggggcgaggcccgaggggccggcggcggcggcggcggcggcggcggcggcggcggcggcggcggcggcgggggcttcccggccgggtgagcggctcggggggaggcggggcgaggaggcctgggcccgcagggagggcgtgtccgccacccaggaggggcggttctcggggtggcggatggggcagcggggaggatgcggcggtccgactcgggttctgttgggacagctcctctgcgccccgtaggtccctcggtcagcgccttcccttgggcgcggcgacccggcgcgggtttccaggggacagctgcccggcgcccctgaggtccctcgacaggcacggcgacccgggcacctgctgccgcgaccctgatcctccgccgtcgtcgggcaggttgcggtccccgcggttccctgcatctgttaagagggcgggggccgggaaggcggtgtccggggacggtgcccttgtcctcgaggcggccctggacgcgtcgcctgcggggcctgaaccgaggacccccccgtaccccgctttgtcctggtgaggcgctcctgccgcgcagcggcatcttcctctgttaacgtcgagaatgagtagtgaaggctgctcattatcctgcattgtaaagtaaaacttgtctttttagaagcgtctcctgaaaattggcgcatctcctgtgcttctctgggttgtattgggaaactgggccagtcgctgtcaggactgtcctgttggtaggtctcgagggaaagaaatgggagagaaacctaccccgtaaatattttcctactcaggtgcttttcgaactacctattaggtgattgcctttttttttttttttttttttcctggaacaaattacaaactgcaggtagaaatcaggaaggcctctttaggctcctcgccaggcagcctttttagcatttttctgaatgtgaacaggtccaaacgacagagcagaatttgaaaagaaaggttttgctgcagattcataacgaggactttatttttcattggtattttaatggtaatggtatagcaatgttttatttttaatgttttttttaaatggctactaaaattttattttgaaatcacagctgtttcagtcacccccaagaaacctttaaaacgtcttattagaaacatttttatatataggaacatttagccatttatacacatttctaagatagaaatcacaatgaagatacgttgtttcactattccaagttccaagtaaccatggtgaatatggtttccccattccaagtaaccattgtgaatgtggttatacacctccagtctttttctatgcagagcttaatacatgagtttttctaaagtgaattctcttttgtaattatctttttctgactagatagcatgccattatatggctgtaatattataatttatttcattggtcattctcagttcttccctattaaaatacattgttgggtaaatgtaaaagtccgcatatctatgattactttcgaatctcactctgtcgcccaggctggagtgtagtggcacgatctcggctcactgcaacctccacctcctgggttcaagtgattcccctgtgtcagcctcccgagtagctgggactacaggcgtgtgccaccatgcccggctaatttttgtatttttagtagagatggggtttcaccatatttgccaggctggtctcaaactcctgacctccagcgatctgcccgcctcggcctcgcaaagtgctgggattacaggtgtgagccaccgcgcccggcccatgattactttctaagtgtacattcctagatgatagaattattgggcagagtatgcacataagggtttttttttttttaatgtgaattgctcaatttccctctggaaaggatatgctgttttgcactcctaccaacaatctgtgagtgtccttacccacaccctagcaaaaggcaacatttaaagggatttctataggaatacttttgagccatacttgtactctccaaccaagtacaactacccctctctagtcatcacttttttcttatttgttgatagcacttcagcttctcatcttttattgcgcctttactattttggtaaagaaagcttatctaggtgaggcaaaggcgtaatagaacaaacaagagatttaaagttaggatccccttgaaatccagtatatctgattatcttgaacaagtcacttaacttttctaaggtactctttcctcagtgatgcattaggggttataatacagttgccttacttttcttaaggattattttaagggtcagttgaaacattcctggaaagtacatttagacacactttgtcttgttggtatttttaaaaattatttttaatttattatttttaaatagagacagtgtctcactatgttgcctaggctggtctcaaactcctgagctcgagcgattctcctgccttggccttgcagagtgctgggattacaggcatgagccactgcacccggccatgttattaccatctggtagaaatttcagagcacagaagcatcttgaggttcatacattttttaaagtaaataccttaattcaaaaggctattctctgataccctttgcccccatactctttcactccttaaatttgaagttttttgttttactgctgccctagattatattcaaaactttatcagggttatgaaattagatgagtgaatgaatctgcacaaatgttgaaggagcaaatatttaaaagcgctatataaagctgagagggacaggtataacgctaaataaaacacagtacttgggctcatgataaataaaacatggtctttgtgccctgcaggctacattatccaggcagcagagggcataaaagctgctttccaaatttagatggcaattttagatgtgatgcctgatgtcaactattctcaagtatgctaaagcccatttctgctgaccaagcacctgagcaagtgaccgggcagcctccacagggtcatctttctgaaggtaggattcgcaaggtgaggaagtggtagtattatagtccaagaacctgggttctactttcaggtcctccacctggggcagatcagttaacttttttgaggctggctttattcactcgtgaaatggaggtaattccagcttcctcatgtgtttgttgtgaggattacatgacatagtacgtgtacaacacttagtaaaccaggaactgctggtactcatgtcatcattcttacccactagagacttagcttccccaggaaagaaagtaggtctcttctaactttgtattcctaccccctagcagtcactggtacttagtcacgtttgataaattaacatagaatgtgaccactgataaaaattcagtttgggggtgccgggcacagtggctcacgcctgtaatcccagcactttgggaagccaaggtggacggatcacctgaggtcaggagtttgagaccagcctggccaacatggtgaaaccccatctctgctaaaaatacaaaaagtagccaggcgtggtggtgcatgcctgtaatcccagctactcaggaggttgaggcatgagaattgcttgaacccaggaggcggaggttgcagtgagtcgagatcgtgccactgcactccagcctgggtgacagagcaagactctgtctctaaataaataagtaaattcagtttggaccaatgaagaaggtaatatgtaaatatggaatattgggaaaaattgaccacgttatttggagttaatgttaaggaatcaaaggaaacattgaactaattggacttagactcatctctgctatgactatcattctactttagatccctaatgccaggcaaatagtccctccttattaagaataaatgtactggctgggcatggtggttcatacttataatcccagcactttgggaggctgaactgggaggatcacctgaggccaggagtttgagactagccctggcaacatagcaagaccctgtctctacaaaaaaatttttaaaaaattagctgggtatggggtatgcacctatagtcccagctactcaaagactgaagcgagaggatcacttgagcccaggagttcaaggctgcagtgagctatgattgcactaccgcacaccagcctgggtgagggggtgagacctggactcaaggggaaaaaaaaaaaaaaaaaaaccgactcaagtttctcccattttaaaacctcattcctagacctctaatcaccctgctgctacctagtttctctcttcccccttcccttcccagctggactgtttgaaagagttgttaataattggctttctcagtttagccctcaagacatgtgttaacagttttcattccttttatttgatctctctgcagtatttaccatgaaagtctccctttttgaaacatccttcttttgtttctgagattctgtgttccaaggttcccttcttcctcctgggaagttccttctcagtttctcctttgctggttcatcttcctccaaaggttgattttccgcaggcttgatccttcttgtgccgtactgtctctggaacaatttatagagcattgaggctatctcgtgtttgaagatttggtagaattccctgtgaaaccatctgggcctgacgctttttcatgtgatatttcctttataactttctcaatttttttttctgtggaaattggtctatttaagctttctaactctaatggagaaaattttagtgatctgtacttttctagcaaattatccctttcatctgggttttcaaatttatttggtagaggtctacaaagacatcctttattatttttaaattttttcatcttatttcctccatgccctcattttgtgtttctgtgcttttccccttttttccttaagttatctaatggtttatctattttattttgttatttttttcaaaaactacagaattttgaattattaattagatctgtttttctgtttttttcccctcattcttttcttctactttcatctttttttgcttgttttttcctgagacaaggtctctctctgtcactcagactgacgtgcagtcagtggcattgtctcagctcactgtagcctctacctcctgggctcaagcaatcctcccacctcagcctcccaagtagctgggactacagtggtgcaccaccacacttggctaattttgataatttttttttgtagagacaaggtctgcccatgttgcccgggctggccttgaactcttggcctcaaataatcctcctgcctcagtctcccaaagtgccggaattacaggcatgagccactgtgcctggcctactttaatctttattatttacttccatgtcctttcttttggtttattttgttattttttaagtttctttttttttgaggcagggtctcactctgtcacccaggctggggtgcagtggtctatcatagctcactgtagccttgaattcctgggctttagcaatccccctgcctcaacctcccgagaagctaggactacaggcgtgtgccaccacgcctagctaatttttttttaattatttttttgtagagacagggtcttgttatgtttcccaggctattcccaaactcctggcatcaagtggtactcccaccttagcctcccaaagcagtgggattacaggtgtgagtgcacggtgcctagcctatttttaagtgttttttgaccttggaataaaatttacttatttttattctttcatttttactaataattgtgtttagtgcaatgaattttcctctgattactgctttaaatgcatgctataaaattggatttgtaggctggttcgagtgcagtggtatttacaactaatcgatggcaaccagttacagatttctttgttccttcttcactcccgctacttcacttgactagccttaaaaacataaaaaagtaaataaaaaagaatctgatatgtaatgttttcagtgtcgttatttctttaaaaatgtataattttggccgggctcacgcctgtaatcccagcactttgggaggccgatgcaggcagatcacctgaggtcgggagtttaagaccagcctgaccaacatggagaaaccccgtctctactaaaaaaatacaaaattagccgggcgtggtggtgcatgcctataatcccagctactcgggaggctgaggcaggagaatcacttgaacctgggaggcggaggttgcagtgagccgagattgtgccattgcactccagcctgggcaacaagagtgaaactccgtctcaaaaaaaaaaaaagtataattttagttctaaaatacccaggagttgcttaatagtaggctattaaatttctacatggaagaggctttctgttttttaaattattgttaataaattctagtttcattgcattataatcagacatattgtttgtaatatttccactttattgaagtggaaatattttttctttgtgacctaatatatgattattttgatgaatgtggtgtgagcagttgagaagaaactgtattcattagtatcagagtgtagagtttgataaacattagtaagagttactctattgagtatgttgtttagattttaggtctccttatttttggttcacctaatatgtcttgtacaaagaatgatgtattaaagtctcctattattagtgtgtttccagtgtctcctcgcatctcttgtagtttttgtctcatgaaggtgattgctgtgttatgtttatataaatacatatatttatatgttatatcttcattgtggggtgtggcttttgggattaaaaagtgtctttttgtgtcacagttaatgctttaggacatggattctgctttgcctgagaccagggttgccattcctagtctttttttttttttttttttttttttgagatggagtcttgctcttgttgcccaggctggagtgcagtagcacgatctcggctcactgcaacttccgcctcccgggttcaagcgattctcctgcctcagcctcctgagtagctgggactataggcgcgtgccgccacgcccagctacatttttttatatttttagcggagacggggtttcacggtgtttgccaggctggtctcgaactcctgacctgaggtgatccacccgccttagcctcccaaagtgctgggattacaagcataagccaccttgcccagctgcctactctccttttgtttccatttgcctcgtataccttttccagctatttatgtatttacttatttatttagagactgtgtctcactctctttcccaggctggagtgcagtggtgtgatcttggcttactgtaagctccgcctcccgggttcaagtgattctcctgcctcagcctcctgagtagctgggaccgtaggcgcatgccaccatgcccagctacattttttttatatttttagtggagacggggttttgccgtgtttgccggccttgtcttctgacctcaggtgatccacccgccttggcctcccaaagtgctgggattacaggcatgagccaccatgcccagctaatttttttgtatttttagtagagacggggtttcgccatgttggccaagctggtctcgaactcctgacttctggtgatctgcccgcctgcctcggcctcccaaagtgctggggttacaggtgtgagccactatgcccggcctaaccttttatttttaaccattcagaatcactttggggctgggtgttgtggctcacgcctgtaatcccggcactttgggaggccaaggcaggtggatcacctgaggtcaggagtttgagaccagcttggccaacatggcgaaaccccatctccactaaaaatacaaaaaaatttagctgggcgtggtgctgcacacctatagtaccagctacttgggaggctgaagcacgggaatcgcttgaacttgggaggtggaggttgcagtgagtggagatggtgccgctgcagtccagcctgggcaacagagcctccgtctcaaaaaaaaaaaaaaaaaagaaaaaaaaaaggaatcactttggtttagatatgtcttttgtattgtaaaagttgttgaggtttcttctgttagtcaaattgaaaatttttattgtaataggtggattaagcccacccacatttattgttaggactgaaaaatttgacctcaaatccatcataatattttataattatgtgtatttgttatctttgccatttctctatgcgaggtagatattttgctcttttattacaaaaattagggtgtgtgtgggggtgtatttaggaaggtttgcatttttgttctaatcgtttacctttgtacttacaccttttaaaataccctcactcctttgtttgcttatttttctgtgcatgtgtgtgtgtgtgcgtgtgtgtgtgtgtgtgtgtgtgtgtgtgtgtgtgaaattgcatctatgtaatcaaagtaggataatgatagacaactgtggaattctgtatctacttcgtgctcctccttactgaagaactggcaataacagataacagctacccaccgtggccaagataataatccatgatggtctcttcaggtctaccttccccttctcactattctactgattgtgctctttttctgtgggctctgacttggtgcgtttctgtgatgggagtgtggcttttttgtttgtttgtttgtttgttgttgttgttggagagagggggtttcactgtgttgcccaggctggtctctaacttctgggctcaaaggatctgcctgcctctgccttccaaagtgttgggattacaggcatgagccaccacgcccagcctgaggcttctttgttgcaaaggctttcctggggaatttttattctttgcatttgtaaatgctgaattcacatttagtgtggaatctctgtcagttgattttttttctgtaacagctttgttgagatagaattaacataacacaatttacccatttaaagtgtacaattcagtgttttttagtatattcatagagttgtgcaaccatcaccacagtctaattttagaacattttcttcacccccaaaaagaaactctgtgcccattagccatcatttctcatccccccaccccttctcccacccaggcaaccaccagtctactttttatttctatggatttgcttattctggacatttcatataaagggaatcatataatagtggtcttttgtgactggcttctttcgcttagcatgatgttttccaggtttgtctgtgttgtagcatgtattggtacttcattcccttttatggtcaaatgatacatattccattgtatagtgtagtattaatatgctcctatggatatttgtatacaagttttgtgtagacatatgttttcatttctcctgggtatctatctaggagtggaatagttgggtcatacagtaactctatgtttaacttgtgggggaactgccaaacttttccaagtggctactctattttacatttctaccaggaatgtgtgagggttccaatatttctacatccctgaaatgcttgttattttgatgatgcccaatttatccattttttcttttgttgctttgttttttgttttgttttgattttttttgtagcagcaattggaaataacgttgctttgtttttgatatcctaacttaaaaatcatttcctgatccaagatcatacagattatttttatgttttcttctaagttttatagatttaactcttatatttaggtccttaatccattttgagttaatttttgtatatggtatgaggtagggtcaaactttaaccttttgcttgtcgatatccagttgtctcagcacccggtgttgatttgtttaacctcttaatatctggtgtatctattttttcctgccagtatcccttaaacccacctattgtgtacatagcagtggaactgcttctactgttctctcttgctttctcttcttctcccgttttctagttgtactttctttttttaactctatcacaatgtgtagcaatttttttttttttttttgagacggagtcttactctgtcgcccaggctggagtgcagtggtgcaatcttggctcactgcaacctctgcctcctgggttcaagcgattctcgtgtctcagcctcccgagtacctgggactacaggtgtgcaacaccacgcctgtctaattttttgtatttttagtagagatggggtttcaccatgttggccaggctggtctccaactcctggtctcaggtgatctgcccacctcagcctcccaaagtgctgggattacaggtgtgagccaccacgcccagccaatgtgtagcaattttacactaatcttccgccttcatccttatctttcttttagtgtcttatatgtacatttacatatttttaaatgctcacaatcagtccttttgctgacatttcccccatttagttgaataaagctcatcctccagtatattcctcagaaagggttagtgagtgcagaattccctatacccttgtaagttgaaaactgtttttcttgttgccttgatgtttaaggaacttcgtgactgatgtaaaatcctcagctcacattactttcattgagttttattttttagtgctgctgtttctcaccttgctttgtattttgtttttgaaaaatctcataatctgatactgatccagttcttttggacttttaagttatttattctttttgcctgggagccttgagaattttatctttatgtttgaaatcacatagtttttattaggctatatttcagacttacttgttctagattaattttccaaggtacctgtgagaccttaaatgtatagattcaggtattttaggtattttaaaatttctggaatgttttcttgcattctgagcaaattatagttttaaatattagtttagttctattgtttgttttttcttcttcagggactgcaattatatgaatattagtttttttctctacctatttgctatttccactactttgtctctgaccctttctttccctctccccactattctctctctctctccctttccctctccctcaatgtcatttttattttcttggttgttttcatgccagccttcaatgttccttattaaattttaatttgagtttattctctcttgggcacattgtaatttattcctcacttttgagatagttgagtctttttctctcatttttttttcttgagttcagttaacttttattctttcattttttcattttttatttgtttttcatctatttctgttcttagtttgtgaatttctgattcaaggtaggttttttaatatcctcaaatgattttgaatatatttaattctatttgtagtacaggcatacctcagagatattgcgggtttggttccagaccaccacaataaagtgaatattgtaataaagtgagtcacacaatttttttgtttcctgatgcacataaaagttatgtttatgctatactgcagtttgttaggtgtgcaaaagcattatgtctaaaacaatacataccttaatttaaaaatatattattgctaaaaaaaaaatgctgatggtcctctaagccttcagtgacgcatcatctttctactgatgaagggtcttgccttagttttatgggctggtgactgatcaggggttggttgttgaaggttggggtagctaaggcaattttttttgggagggggtggagtcttgctctgtcacccaggctggagtgcagtggcacaatcgtggctcactggaacctccaccttctgggggttcaagtgattctcctgcctcagccttccaagtagctgggattataggtgtatgccaccacacctggctaatttttgtatttttagtagagacggggtttcaccatgttggccaggctggtctcgaactcctggcctcaactgattcacctgcattggccttccaaagggctgagattacaggcatgagctaccacgcccagcctagggcaatttcttaaaataaggcaacaataaggtttgttgcatcgatcaactcttcctttacaaaagatttctctggctggatgctgtggctcacccctgtaatcccagcactttgggaggctaaggcaggagtatctcttgaggataggagatcaagaccagcctgggcaacaaagtgaaaccccatctctgaaaaaatataagacaaaaaaaaaataaataagagatttctctgtagcatagatgctgtttgatagcattttactcacagtagcacttccatcaaaattaaagtaaacctgtcaaaccctgctactgctttatcaactaaacatatgtaatattctaaatccttttttataatttcaacgatgttcatagcatcttcaccaggaggagattccaatcaagaaaccactttctttgctcatctgtaagaagcaactctgcatacatccaagtttgatcatgagattgcagcaatttagtcacatcttcaggctttacttcctcttctagctctcttggtgtttctaccacatctgcattgacttcctccactgaagtcttgaacccctcaaaatcatccgtgagagttggaatcaacttcttccaaacccctgttaatactgatattttgacctcctcccatgagtcatgaatgttcttaatggcatctagaatggtgaatcctttccagaaggttttcaattgactttccccagatccatcagaggaatcactatcaatggcagctatagtcttacaaaacgtatttcttaaataacaagacttgaaagtcaaaattactccttgatctatgggctacagaatgaatgctgtgttagcaggcacaaaaacagcattaatctccttgtatatctccatcagagctcttgggtgaccaggtgcattgtcaatgagcattaatattttgaaaggaatcttttttttttttgagcagtaggtctcaacattgggcttaaaatattcagtaaaccatgctgtaaacagatgtgctgtcactcaggctttgttgtcccatttatggagcacaggcagagtagatttagtataattcttaagggccccaggaattttaggatggtcagtgaacattggcttcaactgaaagtcatagctgcattagcccctaacaagagagtcaggctgtcctttaaagcattgaggccaggcatttacctctctaattgtgaaagtcccatcttccaagagaaggctgtttcatctacactgaaaacgtgttgtttaatgtaaccaccttcatcagcgatcttctggataacttgctgcagcttctccgtcagcacttgctgcctcactttgcccttttatgttatggcgatggcttctttccttaaacgtcacaagccaacctctgctaacttccaactttgcttctgcagcttccttacctctctcaggcttcacagaattgaatggagttagagtcttgctctggattgggctttggcttaagggaacgttgtggctggtttgagcttctatccggaccactcaaactttctccatatcagcaataagactgtttcactttcttattcatgtgttcattgaagtaacacatttaatttccttcaagaactttccctttgcatccacaacttggctgtttgacccaagaagcctagtttttggcctttctcagctttcgatgagccttcctcactaagcttaatcatttctagcttttgatttaacgtgagatgtgtgactcttcctttcacttgaacatttagaggccattttaggattattagttgacctcatttcaatattattgtgtctcagggagtagggaggcctgaagaaagggagagagaaggaagaatgccccatcagaacacatactacatttattgattatgttcgcatcttataagggcatggttcatggtgcccccaattacaatagtagcatcaaagatcacagatcaccataacagatataataatagggaagaagtttgaaatactttgataattcccaaaatgtgatatgacacagagacaagaagtaaacacatgaggttggaaaaatggcactgatagactcgttcaatgcaggtttgccacaaaccctgcatagtaaaaaattctgcatttgtaaaaaatgcagtatctgtgaagcgcagtaaggcagagcacaataaaatgagatgtgcctctacagacttactgtttccttttgcttcatggttttttggggagaaaattttcgcaggtaggaaattctgttttctggctgggcatggtggctcttgcctgtaatctcagcactttgggagactgaggcaggtggatcacctgaggtcaggagttcgagaccagcctggccaacgtggtgaaacctcgtctctactaaaaatacaaaaattagccaggagtggtggcgcatgcctgtaatcccagctacttgggaggctgaggcaggagaatcgctggaacccgagaggcggaggctgcagggagccgagattgcaccactgcactccagcctgggtgacagagcgagactccatctcaaaaaaaaaagaaattctgttttcccactctcttgtcaacacatgggtgccatcagactttaaaatttttgcaaatctcatgagtgtgaaataatatctcattattttcatgttatttcctggattcttagcagggtggagtatcttttcatgtgtttattggacatttgtatttcctctttgttgaaaactggaagggtggagctgccatttactgagatgggacagactgtaagaggagaaaatgttggagggagatgaggagtttgctcatggacatgtttacagaatccagtgggctgttggatatgcaaggctagagtgcatgggatgggtgtgagctggagttataaatttgaggttgttagtttatagaggatatttaaaggcatgagactgaatgagagtatggacacaagtccaaagaccaaagtcactatttagaggaagactgggttcactcttaagggtcagggtgatgacagggaagatgaggagaaatggcaaaagagacagaaggaattgttatagaggtaggaggaaaaccaagaaagtgtagtattctggaatccaagtgaagaaaatgtttccaggaggaaggtgtgtgaaatgctcctggcagccatgtgtggtggttcacgcctgtaatcccaatgctttgaaaggccgaggcaggaggatcgcttgagcctaagagtttgagaccagcctggcaacatattgagtcccatctgtacaaaaaattttaaaaattagctgggcatgggccgggcgcagtggctcacgcctgtaatcctagccctttgggaggctgaggcgggcagatcatttgaggccagaagttcaggaccagcctggccaacgtggtgaaaccctgtctctactgaaagtacaaagattagtcgggtgtggtggcgcacacctgtagtcccagctacttgggaggctgaggcatgagaatcacttgaacccgggaggtggaggttgcagtgagccgagatcgcagcactgcactccaccctgggtgacagagtgagactccatctcaaaaaaagaaaaaaaaaggaagggaaaaaaaaaagaaaaaagaaccatatagtaaatattttaggctttgtgggccacgtacagtctctgtcacatattcttcttctttttttttttttaacaacactttaaaatgtaaaaagcattctcagctcaggctgtatgtttaaacctcctctcttatctatcaagcagctgaactagtacttctcgttatcagctgatgcccactaagcaattgcaaacaaagttaactttaaaaaatagctttatagtttactggtttaaagtgtgcatttcagtggtttttagtatgcttgcagagttatgcaaccatctccataatatctgatctaattttagaatattttcatcaccccaaagctaatgtttttacagctttgaggtataatttatatgcaataaaattcaccatctttgaatgaatagtttgaaatttatttatttatttatttttttgagatgcagtctcactctgtcacctaggctggagtccagtggtgcgatctcggctcactgtaacctccgccccccgggttcaagcgattctcctgcctcaacctcccgagtagctgggactacagccacgcgccaccatgcctggctaatttttttgtatttttagtagagatggggtttcaccattttagccaggatggtctcgatctcctgacctcgtgatccacccacctcagcctcccaaagtgctgggattacaggggtgaatgagctgccgtgcctggcccatttgaattttaataaaactaattttaatattgggtgaaggaaagtgttcttaataatacttcttttatcacatgcaataaatgtcgcttgtaaatattttctcccaagtgatgtccacttttcctttaaaactagtggttctgtagcccctggaccagcagcatccacatcacctgggaacctgctagagtggggcccaccccaggggtagggcccagcaatctgtattttaaccagccctccaggcgattctaatgcacactaaagtttgagaactactccagtgtatattcctgcatggaattgctgggctgtgggatatgggcatgttcgactttattgggtatttccaaactacaggtgacacttgaacaacatgggtttgaactgtgtgggtccacttatatgtgaagtttttcccaatgaaacgggtatagaaaatacggcatttgagatatgtgaaagctgcctatacagagggacttggatatgcacggattttggcgtatgtggggattctggaaccaatcccctgagtgtaccaaggggcaatggtattttcaaactggttatactgtaccatgtacagttcacctagcagtaactgagagttcccattttcacacatctttgccaacactttggaatatgcaacttaaacatttttggcctatctgatgggtgatcatagccctttggcatatcaaatggctatgatcttaatttgtattttcccaattgctaattaagttgaacatctcatacgttcataggtcatttgagttttgtgttctgtgataatggagtcttttgcctattgaaataaatacagttatgtaaataaatacgatgtgttgaaataattgcaaaataaacccagaattcccaaggagaaagaagcccagagggaaaaaacagaaagtccaggaaagagtcctaggggatgtgatagttacacaatcgggaaagaatagggatttgtcaagctgaccgagggaaggccatccatgtgctggacgagcatggcctgatcagggaaagcaagtagtgtggtgtaggggactagtagggtgtgtgggggaaaagacacacataaggctgggagaaaggtaggaagcaactagatgtatctatcttacatttgtttaatcttttttgttgagcatttgggttattagttttcttgagctttttttctttcctattataaataaaactgatacaaacatcttagtgtacacagctgatttttttcttttgaattattttttaaaacaagtttaaactgaaattactagattaaaggaaaggaggtatgattagtttcatagtttcttgtaagaaacatgtatgtttcaagattactctccattagtcattagggaaatgcaaatcaaaaacacaatgagataccacttcatacccactaggatggctatagtcaaaaatatagtaagtgttggtgaggatgtagaaaaattagaaccctcatacactgctggtgggaatgtaaaatggtgcagctactttggaaaagtttggcagatcctcaaaaagttaaacatagagttaccaagtgacccagtaattccacttctaggtatatacccaaggaaatgaaaacatatgtccacataaaaacttgtacacaaatgttcgtaagagcgttatttataatagctgaaaggtagaaacaacccaaatgtgcatggagaggtgaatgaatgaacaaaatgtaatgtacccatacaatgaaatgtctattattctaccataaaaagggatgacgtactgatacatactacaacacaggtgaaccttgaaaacatgctaagtgaaagaagccagtcacaaaaaaactacatactgtttgattccatttgtatgagatgtctcaaataggcagatccatagaaacgggctaagcaggggaggggagaagtggggattcactgctaatggggtctcttttgggaggatgaaaatgttctacaactagacagtgataatggttgtatatcactgtgaatatactaaaaaacattgaattgtatactttaaatgggtaaattatatggcatgtgaattcaatatcaataaatatgttttgtttttaaaaatggaaaaaagattatgctccagaaaaattttcctttctcattatcatcagcaatatttttgttcccacccgcccccaaaaaaattaccacctttgggtttattattttcattaaatttaataggtatgaactgatacccagagtttatctagtgaaattataagcttccctattgaatgtaatctctatcagagcaggaagttttgtctgtttttgttcactgctgtagccctagaacagtgtctggcaaataattggtacacagcaaaatttgttaaatgaatacattttgatacttttagttactaagtaaacattttttcctttagtgttttaatttcataatactttgtgagctaattgttcttagcctcaaaatctttttagaaagaggctgtgtataactaaatgaattgaattgattgtacttcctttaatgagtgatctagttcaagttctttgacttgatatgcttttactttcttttgaaattcaggataacagtagtttgcaaatgtttgagtatgaggaccgccttttaaactgatgtctacataataattgtactttttgtatctgtgggtggaaaaactgcatagtgacaagaagcctttatattttagtttcaccatagtgtcttcagaaatttgcaaaatcgaggtgcataatatatgagacatacacttatttattctgtggtctgtgcacggtagctatatgataattcatgagcccatggcagtcgttctagaagccaccaggggtttgggaccactaagttaggaactacttaatattcgtatcagaactgaggaggactactgagttgtaaataatagctagtataggagattatacctacttatgtgtttttaaaattcagtttccgaagctatcagtttcttttaaagactgaagaatatttgaaaaatcaagtttagaagtgccttttaaaatttacttatttgacattatttgttttagcaaaaaaccagaagcaaactaaatgtctaataatgttcaattatattttgggcatatttgtctggtggaaagttaggcagcagttgagtattagaaattgtaattctgaccggatgtggtagctcacgcctgtaatcccagcactttgggaggccaaggtcggaggattgcttgaactcaggagatccagaccaacctgggcaacatggcaaaaccccgtgtctaccaaaaatacaaaaattagccaggtgcggatgtgcacgcttgtggtcccagctacctgggaggtcgagcatcgctggagcctgggaagttgaggctgcagtgaactgtgatcgcaccactgcactccagcctgggagaaagagcaaaaccctgtctcaaaagaaaagaaattttaaaagaagaaattataattcttagaatctaacaatttaaaaagcagagtataccatcacgtattcctaaacatttaaactgtgattatatgaagtgtttctgtacatggtgaaagacaggaaagtagtagtgcttgtattcagatagaggaattctgggtaatttttcctctttttggaatacttatttagcagttgctgttgccagacaccaataagctctttttatgatttaatttaggggtcattaaactacaatgcatttgacttgccgggcctatttttgtatgacccacttgagctaaatagtttttgtacttttatttttttaatttgaccaacatagtgcctttaacctagtatattcaaaatatttcaacatgtagttaatattagaaatacatcaataaaatattttacattttttatatgaactctttgaaatctgatgtggattttacacttacgacacatctcaatgttgtcacatttttacatttttaaagagttgctttaaaaaaaagaagaaacagatgtgacagagaccttacatggcctgcaaagcctaaaatagttaccacttggcactttgcagacagtttactgacccctgatttaattcattttatcctgacaacattccaataagaaggggtgctattattatcatttccatgttagagatgaggaagctgaggcacaaagggtttaagtcaattggcagcattcgctatgttttagatcaaattgtagggtctttctacaaacctgctaatcctgtgtttctttgcagtgtaaaaagtggatagtggctcacgtgtcaaaggatggcacggtcacgatctagatcccccaggtggaaacacaggtgagcagttcttagcagagtaagcttggatttgggatgtgctgtgactttcaatttcaccagtactagtaaacacttaagctcatgggacctggttattcacagtaggtactttatcatagtggaggttgtatttctacattctagtagctgacagctttgtttaatcatagcaggtggctagagttaaataatgaaaagcagtgcagtggccacagcaagagagagtgagaaatatctttgagagtattacattttttgaattagtgagcagtttagaactcctcagtatggatttcattttattttttcataattaatatgtttaaagaaatttcgagttagaaaatagggagtttcctctttcttcttcatggcagaataatagagttttgaatagttcgattatagtccatttctccttccttcttggtagtatcaaaattatgtatcattagattggaacaatttaaccagtctttattgtacacctgctacaggcaggttcttgggctacaaaggcaaatatgccatcttctttggcctcagcaagcacgtggttgggctgggagattgacaccatggccaactatgatacagtggggaaaatgctgtgctacttattgggacaaaggattctggatttctagggaggaaataattctgtttttgtggaggaaaaagagggtactaagaaagtcttcaaagaagagatgaaaacaattttatctgggcgtttcaggatgtgtagaacttctaaaggcagaaagagtgaagagaaatattctagttaagggggagagcaggagcaaaggcaccgagctgtaaatgtgactagtattttctaggacttaaaaaggaccatcatttcacacaaaaaaggcagaccaagatttttcatgttaagataacttgcccattttgcttgtgcatttcagttatgcagtaactaatcaatcattttgtcaacagttttcattttgtaattcacaggagccacttgcaatggcaaggaacttgagaaagaaaagggaatgtatagaagtgaatgattttaacagggtatcacagaggtcatttatttttattttttttatttttattttgttttgagatggaatctcgctctgtcgcccaggctggagtgcaatggcgtgatctcagctcactgcaagctccgtctcccgggttcacgccattctcctgcctcagcctcctgagtagctgggactacaggtgcccgccaccacgcccggctaattttttgtatttttagtagagacagggtttcactctgttagccaggatggtctccatctcctgtcctcgtgatccgcccgcctcggcctcccaaagtgctgggattacaggcgtgagccactgcgcccggcccacagaggtcatttcttgataagacaaaaggcgctgatgaggggcacaagagaccctgccaagcttagtgcctgagttccaggttccttctcaggtttctttgttaagaactataaaggatctgatattttaccttacttgcaaactaacacattattagcctgccacagggcactcttgggtcagagacaaaggcctttattactcagaatacagcaagcagcttgagcttcatgttcctgtcattccccccaccctctgggtcccgtgagggctgggactgcagagccactgactggatggatgccgtgaggcagcgagctttccatacaggcagtggggttatagtacaactgaggaacatgagtcccttatcaggggctgcagataaacccatcatgcagcctttgccttggaggagacatttattttattatcctggacagcaaacacatcagcccttttccctgagtgagaccctatctctatcttgcaacactgccttagaacaaaggttgtcagtgcctctgctcacagggcgctcgcaaggcgtgcagaactcaagagactgtggagaattatctcccaacagactccttgagtcttttttgttcctttaggaaaaccaaaaacaatagcaactgttccagcaaacttcttcggaagaaagggacactgtgctatgaaacatataaaatagcatatcaaaccgatattgaatgtgaagtaaggattaaaagtaagttattgggaattccatccagactgcaagacctttgactctggctgccagcttttctccttggctgtgaaagagatgaaatcttccaggaagtcctcagaggctccacttgcttcctcctgtgatgaggtgtagccagctggatggcagagtttctgctttagctaaataacacttgccagtatgtctagcttggtgactccagagggcaatattgccaagttcagtatataactcctagtaggtacatgaggaaggtagatctgcctcctttcttgtagggagggcacagacttatcatcgaaaggaaagggtttcactcatggttgcgccaactccatggcagcttctaagagagagccataacagaagctgcaaggatcgcttcctcattgattagaagacattaaaccctcagggaggagatggagaaattgggcagctcagatggtggaaaggtccccaggtgcaaaatggaactttattgtgtcccagatagtggcacacctctctttacgtctaggcaacccagactggtttccctggatacagaagccttccgccttagtggaaacacaagcctcaatgttggcaatgctgaggtatggagaaggtagttccataaaggatgtgctgtccctggagagcattgtagctgctttaaagtataacttcaccgaagttacaagctctgttcgaacagcacatctttccatagatatgcaaaggaacagatctgggaaagaaaagcaacttacctatgttagaggtatttctggaggaactaagcatgagattcaagtcttaagagcctcttgttcccccttttcccccggttaagtacatatgttttgttccttgatacagccttagtagagaaagtagacaatcagctggagaaactctgggcctggcttgggtctgagtttgaattgtagcatcattaaatcttagactctaatttattgtcagaggtaatgttcagtttgctggagaccctcctacacattgatttgtgtgagtcttgccttcctgcttgtttcttacctggcctttgaactggatgtaagcttttgttgactggccctttgaagtcactgcatcttcttttgccagaactttgctgtcagcagtcttccaaaatggatcctgctgtgcacctaagctggccctcctccaatgggacaggtgtgctcagctcatttggataagcacgtggaataccttagttcagatggaaagagtatgcttgttggttgggcagtaccataatcagacccccagatgtacaatttagaatgcagatgtagcaaattgatgaatttagtttgagtggaagaagccgagggatcctaggaaaagcaactgtttttggtaggtcatattgagacacgcttagttgattaaatggtttacacttttctgtgtttgtttacataggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtataggaaaacattaaacctgggtaatttggtataaagcctcaagtgaaaagatctgtttactttatggttgaagataaccaccttgaaaagcttttgtctaaaaagacaaaaagcattgtaatttaattatggggtactggtagtagtgaagtatttctttttagagtaaatcatgttgatggctagaatacttttaaaagatggtattttcctctttaactgccttgtgcctatagaattggcttaaagggttatagattaacttgccactgcattctgcatttaaagccatgctgcccgacattctacacatataaattctccctttcttctctctattgcaagtgtaaactgctttatgtcaacacaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcaggtattatctttgttttttctttatgatatttaataatgtttctacaatctttatttgcagcttcaaaaatggaattaatagtgtgtttagagtccatcaagtgggagggattgccaagaattttcccccccaaaaaaaaagccctgtagtgaggctgtttcctgtgattagttacatgggagcaatttcatgtctccttgtttccacatcctatctccagatgcttcttggatgcggggcattctgtggagttgttcctcttcatgaattcacgtgtttttatgctgccaggttttccttatccaaggattagctgggtagagttcaagaaaacctagtccttgctcagtttctcagagcctgtgctctctgttgcctgaaattcagagaatttttgagctgaaagggaccttagcaggccctagttttatacgggaggaaagcgcgaccctgagagatgaagtgacttgtctaagtcagagtggctcgggctcaaatccacgtgttcccttatgactcaacgaggcaggtgacttaatgtggtttttgctgccgtctcataatgactggggctcaaccaactagattctcccaggtagaggagattataccataatctgggaagatacctatttataagacatttactttagcccttaatgattctttaaaaaaatagactgttgttgttgtaggttatattctcttaaaagcagactcacgtgctttgttccttaacgaatattacttccatttatggattctgagaataataaagcactgcagttggcctaaaactaaacagctaaaactgttcatgaccttaatacactaccagtatgtgaatgaaaaaggggggggccatgttgatttggtatgtttatattcatgcttgactcatttgtatttgaaccaaaaatgagagaaaacaaaatccaaatggtagaatggggagggaggtaaacccacaagtccttttttgtaaaacaaaatattttttgttcctttttcttttcttttgagacaaggtcttgctctgctgcccaggctggagtgcagtggcatgatcacagctcactgtaacctcaaactcttgggctcagatgatcctcctgcctctcctgtgttggcctcctgagtatctaggactataggtgcatgccaccatgcccagctaatttttttctttttttgtagagacagaatcttgctctgttgcccaggctggtctcaaactcctggcctcaaatgatcctctcgcctcggcctcccagagcagtggcattatcagcctgagccactgtacctggccctgttccttttcttaaatttagacatggcaacaccccacctcatagttcttttacattcattgcacttgtagaaaatatttttaaatatacatatgtgcatttatatatgtgctcagaaagcatttatgattatattacagaaagttcaagaaataaagggggggaatcacccatagttctactactctacaacaattttatttgcattttagtctagttatttttctatgtatatttacacatgactgctgtggtatcatattaataattttgcatctttttacatatgtcttaaataattttgtgctattatatctcctactagttcttcatcttaaaagcataaaagcttctgtaagtaccaagtttaagaatgttaccttaagggctgggcacagtagctcatgcctgtaatcccagcactttgggaggctgaggtggaaggatcgcttgagctcaggagtttgaggctgcagtgagccatcatcatgccactgcaccccagcctgggcaatagagtgagactctgtctcaaaaaaaaaaaaaaaagggagcttggattattggattacattctgatggctataagatatacatatataacatataacatacatacttttctttctttcttttttttctttttgagacagggtcacgctctgtcacccaggctggagtgcagtggcgcgattatggctcactgcagccttgaactcctgggctcaagtgattctcctgcatcagcctcctgagtagctgggactacaggcctgcaccaccacacccagctaataaaaattattttgtagagatagaaatcttgctatgttgcccaggctggtctcaaactcatgacctcatgtgatcctccctccttggcctcccagagcactaggattacaggcatgagccaccatacccagccttaagctttttttctatccaacattctactttgaaaatgttcaaacatacagaaaagctgaaagaattctacagtgaacgcctatatactcaccacctaaagtctacaattaacagtttactttcataattacacatctattcatctattgttccaccttattttttggatatttttcagagtaagttgcagatgtcagtacactcccatttagataccttatacatttttgtttacagttcctcttttttcttttgaggtaaaattatatacaatcaaatgcataaaaatctttaactttttaataaaagtaatgatgtggccaggtgcaatggctcatgcctgtaatcccagcatttgtgggaggccggggcaggctaattgcttgagctcaacagttcgagaccagcctaggcaacatgatgaaaccccatctctacaaaaaatacaaaaattagctgggtgtgttgacatgtgcctatagtcccagctacttgggaggctggggtgggaggattgcttgagcctgggagatcgagactgcagtgagccatgtttgtgccactgcactccagcctgggtgacaaagcgagaccctgtctcaaaaataaaaactaaaaaaataaaagtaatgatacccccatatttaataatgaagtgtgttatagttaaaagagaattaaaaaattgtaacacttttaaagaatgctagaaataccagttttgaagagttttattttaatagacctcattagagatactgaacagttaattttataatttgatatgagaaatggaagcttgatctttatcatgtgtcacaaaaatgggcttaaaatggagactgctgcatcttttgaatttataaactatgattttgtgaaatctcataatctgtcaatgggatctggtggcataccagggccatttgaatacctgcccagggcctgcaggatggcttgtgtaatagcctccactgcaaatcctctctgttcaaagacctgaaaaataaataactgagcaaatatatgcatctttgcagtatgataaagcgtcatagtcaacaaaatctttatttcctggtgaatgggttgtggatgaattttgtggtttggatttaattatatgtggactgatccataaaacaaagataatgccctcagtagaattatgttttcaactattaaaataaattagatttttttttctagaaaagagtaaaataatcatagagtgcagagagaagtttatttattggttaacatctagagagtttatctgcttttttttggaaatgctaagatggctaattttgtgcatttatttacttagctttggttgagaattgatatttgttcttccaattgtcagtatggttgaaaacataaggttatcactgtgatttttttagattctagtttgtatctagaacagcagtaggtaaacacttgcttgaatgttcactgcatagttaatgcttctgttaagaaagactgtattctaatgatccactctgtcagaaacttcattatcagaaattacatctgagtcataattatatgtttcagaatgtaagttagggaatcacagtatgaaaatttctactaaggttgttacatatgcaaaacatgaactgttgtatatatgcatctggatgttttggggcagacaaatgcaggtgttagtttaatgttgggcttgagtgagtgagggcttgacccttggctaggccaggaaggaagaggaggagggaggaggtggtactaatatctggagcagaataagctgctgctgatggatcagagactcctttgatctcctgggaagctgatacgagacacctgggacatggggaaggttgtccatcagcattcatggctatcagagttgatggtggactgagtacattggccacatttgtgtctaatcctttatttcccactgaagagacatagaggggtgtctctacccctatcagctcttttcctagtttgaaaggggatgaggtgggggatgggccccagaggacattgggaccctgacactctgaggaaatgggtatcacgcaggcagggaacaatgtgaaaagccataactgagattgaaggaagggaacctagtcacataagtgtacctatgatggacactgttccgctggaggcaaaataagatgcaggtggggatattttttatacccaaacctgccaccttgctgttatatagcatagaaaactaaagttctcccctactttaatttctcatatgcattttaaaatcaaaaattaattgagagaaggttccctttcattcctatttttgaccctagcttctcttggtgtctcttagggggccttgtgtagggattctgttggcagttagagtgcatatgtttttgtcttcctatggaccactgatcagctttgtgacattgggcaggtcacttggctgtaaccttttgggaccaaattaacctgcagttcctcctggctctttgagtctgcttggattggccatgtgttggtgaccattgaagctgagttgacagacacatggaggctcataatgttcatctctgaactttagtatatattagaaattttatactaaaatattaaattcaaattggtctaagttaagcaaaaaataaaaataaaagccaagaaagttaaaaaaaattaaattggcctcaattaaaatgttgaagtctggctgggcatggtggcccacgcctgtaatcccagcactttgggaggctgaggcaggcagatcccttgagctcaggagtttgagactagcctgggaaacatagtgaaactccatctttacaaaaaatacaaaaattagccaggtgtagtggtgcacacttatagtcccaactaatcaggaggccgaagtgggaggttggcttcaggaggcagaggttgcagtgagccgagatcacgccactgccctccagcctgggtgacagagccagaccctgtctcaaaaagaaaataaaaataaaatgttgaagtcttttctctctctcggcagagtcttgctctgtcacccaagctggatgcagtggtgtgatcacggctcactgcagccttgacgtcctgggctctagcgatcctcccaccttagcctctcgagtagctgggactataggcacacgccaccatgcctggctatttttttttttttatttttagtcgagatgaggtcttgctgtgttacccaggctggtcttgaactcctgagctcaagcaatcctcctgcctctgcctccgaaagtgttcagcctcttgagtagctgggattacaggcgtgagccaccgcacttgaccttatcatctctctagctgaaacactcatttcaaattgaccaagtcatttttgattcattatttattcattcagtgggtattttttgagggcctaccctgtgtgagacagtctgttagggtgccctgggactgtagagctgcatacgattaggttcctcctcctttggtttattggagtgcatgtgtgactcagcagaagatgggtggtaccaagctgggagattgaagagaggcatcatgtagttgacatgtgagctaggcttcaaaggctggtgtatgcagacacatggaggcaaaagaaattttatatttacaggttaacaatggcagaaaaacatacacatgaactttgacctgtgtggttttgagcagtcagtgaaaaggaatagagggaaaggagactgaaaggtaagaatgctgcgactgccagcctgatttgacattatcagctgataggagagggctggcagcccagttctggccgccagaggattgctgtctatgaagtagactgaatgcatgttggggctggtgaggcccactagaggacttttgtgcaaaaagtgaggaattaggggaggagcaatctccctgaactttttccatcaactccacagtttctaaattggttcttgggaagacaggagcaaattatatacagtcatgcattgtgcaatgatggggatacgttctgagaaatgtcttgttaggcagttttgccactgtctgaagatcatagagtgtatttacacaaacctagatgatgtaacctactacacacctaggctatatggtagagcctattgcttctaggctacaaacctgcacagcatgttactgtactgaatactgtaggcaattgtaacacatcagtaactattcgtgtatctaaacatatctaaacatagaaaaggtacactagaaatacagtaccaccatcgtttaagtggtcattaatggaaacgccgttatgctgcatgtgactgtaattgggaaagtgctttatatgaactgtaggatgctgtatgaaatgttagttattagttggaagaagacagaaaggaaaactttatatgtgtcgtacggattttgatagaagcttccagagggcaggggaatctgttggttttggttgttgttgggttttttgttgccgttttgccatgcagttcatttctttgatgagtcctaagtgtgtgcaacaggaaattaaggtttaatgtagctttttacattttcttggttattacccacaacgctcagggagaacatcagtggaaatatccttaaacagaaaaataaacggggaaagtgcagtcgagggaacaaaggatcttggaagatttaatgaaactgataccagaaatagtattagaatagaggtttttggctgtattttaattttttaaattgtctaaaatgcatctcaaatgagaacatttgatctttttagcttaactacttgctttgggggtatttcctgaaattattaacttgttaatcaatccatgccacaggaaatagtaaaaagtaaaatgtgaaccaaaagatgattacatttacaaatataaatatttagaacattttgcattctcaagtctaaagagggtttttcttgtaccaaaagtatcataattgtttttaaaagactaaaatttggaggttatactatgttaaatgtatattttctagaaaatgataatttaaattttttattaaagatcttgtagtagaggaactctaggataaattttaatggataacaagtttaaacactaagattttaggaattaaatatataatagcttcaaagtatgtaactcctatggattgaggattgagcatggagtggggacaagagtttcagcagtaatttgtaagaaattataagtaaatgttaataattactcattggaaaactgaacatctttatcagcttatttcctcttgggataaactgaggctgccagaaaaaaaccttatcaactgatttcctcttgtggatggaccatttgtatagttctatttaaatatactattttcctactataaaatgtttttaaaggctattttttcttttgctatggcacaggaattttgtaactttagacccccttaaacagagagcatttgtaattctttgttagtggaggtcgttacggggtgttctaacatttgccagcaaatgtctcttagctagttatcacatacacagtgggaagcttggagcaaattaggaggaaagaagggaaatgggccttctttctaatgaaagtccttctaatgaatcaacgaaaccacagcagtgcggtcaacctgctgcatgattacttttctgtgtttctgccttggcagggagttgaccctggcaacgctggtctgagagcagggagcacggaaagttagatggaagcctttcctctgataagttataaatagacactcaaaaccattttattagaggagctaaaatttttaaagaatatctgtaagcccctcataaccctgcagcagtttggatatatggctgttacatgacttaaataaataagtacatatgtgcatgcgtgcactcatacccccagacacatctgtctgtttgctttctgctttatgatgagctatttattccagtggtgtcctgttatttaaaacatacttcagggctctctttcagatttatcttctgagcctgtaatgtagccattaagaaccccagcagttgcaaatgtcaattctttagacagtgaacttgatttttgagaagagccaaaagcaatttagagttaagtacagaggaatgagataggtacaagctgattagtgccattttgggtccaaaatgagatataaatataaaataatgagaaaattttttcattgatgcatgaggtgcctgcagacaaagcatttctgagtagttttaagcaagtgcagcattcttggaataaggtatagttttccattacaacacttggaagacatgttcatttgaatgctcaatctctgggatgtgaaacaaagcaaccaagacatccattgtctcagggtggtggcacctttccccatagggttattgtaaagatgaaatgagatcatgttggtaagctctaagccccccacatgagggcatgtggtaagccctgaataattgttagctctgtatcataaccattagtttgtaaaagtacttagaggtcaggagagctcttaacaaaagttataagattcagaaggcattaaagtggtaagatagccggggttatataataaatggtagtatttctttaagggtacattgagggtgaacactgtaactggtgttaacaatcataactttgcctaacaactaagactatttcctgagaatttagtgagactttgtaattaagttaatctcttaacagaattttatttcaaaatactattctaagcttcttattattgatacaaagatataaggatttttattaagttagagaggttcttatgtttgatatcagcttttaaagtgtggtagtatttcaagataaaataattttgctggactaacaatgttttggccatttggaagtagaaaataatctaatcgattactttttgcatagtaagtgtctttaataccttgtatttttcaagtaaaaattgtttcacttagaatttgaaggattttattattaaagtggcaaatatttaatgacctctgatttgaaagaactcagagccatgtatctgtagttattttctcctacttgttattgtacatgttttatggcatggaatttagtgccttaattataagaaaagatatacatctttctagttttgtagctatcttaatttttgataaattcttttctccacaaaatagtttcaaatttagttaaacatttgcaaattattctagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaaggttggtatattttgcacatacgttagggataacacaaaagtaatatactattcacgagatacaggtaaacacctgcagtatagtttaatagtaattaatatttcattgtaagctagactgtgaattaggaaatcttttgaagagagtatcaggcattcattcgagcctagttgttctttatatctagttccaataaccttgtgcttcaactgttagtagattggaactttcaagttagaaagggagaggctggctgctgcgaaagaaaaggcatactgagagcagtaagaaacaataactggtaacctaacagggaggaaaaagcaacaaaaaacagataggaaactcaagaaatcaggaagcctaggtcattttatgattcttaaagccccctgagggcattactaggactttgtatcttaaggatgatgctgagtgatcagtgaaagattctagtttgctttggcattctttataactgggagttgcgtaataaatacttttaatggtttgcattaaattgttttgtttttgcttctggcgagtttccattaattggaaaattcagtgatatagaacaactttccccagtgatgctacacaaataaggcagttgtaggtattacaaactggaggccttcaagaatttaaaattttttattttgtgcttcctactagacaattgcattaatctttcttaccttcataaaatatgttttgaaaatgagtttttttcctctgtgtccctcaaactaaggcatgtatttactttaaagcacatagtttgtctgaaacagttcatcctctcagctccagtccctgtcacccaaaggaaatgtgattcttggcagaaatggagctgatttgcagaaaaatccaggagattgtcccagaacagaaacagtaaattagggaagaggattgcttaagtagcattctgatggaccaagtgtattctctttctctgtatcctattaaaagtgtgtagcatagctgatttctaaatgttttcatgaactttaatgtgaattaaagtaaagtggcattagaaggccttctgtgatatgcaaacataacatttagtatttgtttgaaattgttttgatgtttcaggcttgtttttgaagttactttttattttcattcaactgtgaagctctatgccatctttactttccagatatagtaagtcttaccttggagaagaaaggtccttgctttgagagagccattgtcttttcccctggacaagtaagcaggcgtgtcagatagaaagaaaattcttcgattaataaatcaggtgtttttactcttgtttgggcttgggaaggcacgtgagcgctacaaattagtctgtgaaataagtttgggtcccacatatttttaagagaaaacaggttgaattttaaaaaataatcccttctttctgtgcttatatgtaatcttttaagtgaaatcagcttaacattgagataaaactcttcatttcctttttcagcaaattattttccatcacctggcattactttacatgagcgtttctcaacaatgcaagatatacacaaggcagatgtaaatgaaattccattgaattcagatccagaaatacacaggtaatgattgattaccatattatacccatttaactaatggggatatacctcagaaaagatttgggaaggggctgctttccgaacctgctcacttgggcttgctgtagactgtaggattgcatttcctgcacaaaaataataggataatccaagcattatctggccactgcactttgatggaatgaataggatgcgctgaaaacattgactagcgttgtttaaatgtgtaggactttgaagatgcttacatacctaacttcacttctgctgtcaatagtaattgcttcctgaggtcctcagtagaagaatgaaagacagttttcaagccatcgaaatcatatgttgcttcgtgtggtcacaaataggtgttctgagggcagccagatgaaaccacgtgtcttctgctggcacttgttggagcaggtggtgtaccctgtcttgtgagctgatttgaatacatgtgagaatgcagtatatcaccagagcaaagtttgagattacacagactactgatttgagaaccactaaagcttccctatagtgtgttccacaggatatgtatatcctgggagactgccatataggtgaaaaactatctggtagcaagtttcttttgctagctccaaaacatactagctttatttcaaattctgttctgtaatagtagaatcagggtatcagtgtataacataattatttagttgtactatgcctttattattttaggagaatagatatgtctttggccgagcttcagagtaaacaagctgtgatctatgaatcggaacaggttagtgaatacaatttttgatgagaaattatcttattgtttgtatattaacggcaaggggcttggtggttgggagagaaaagggagttaaagtacatgaagaaggaggattgaaacccaggaatctgaaattaaaaaagtcttcaggtgattctgactatcagccaggttggagtgagaatactgacaaaagacaaaaatattccctaagagggacaatccctaaggataacagctttgtaaaattgacacgcaattacagcatttgatattcatccccaaaatccgcactgtaaagcttatggaaagtatgttaggtacctatttttttcaaagcaatcacgtggaatatatttttaaattgtacgtggaatgaatgcacaggaacgaaaaatttcatttgatattgcccttctgtttactgcagaatgtacgaaacattctgtggaatatgaactagcaaaataagggaaataagggactaaatttctttattcatgtgtgtcgttcccacccgacacctcccctcccaccccccatttctttgctaattagaaagactgtcttgactagccaggagggaagaaaactggctcttgttttagaagaattatatcaagttctaaaagaactgctaatttattcattgaggataaagagtctttgtagaggagatattttaatacatttctgatagaatatataaataattttttcacttgtgaaatgattataatttttgctgaacttatggagataggttaatttgttgaacaaatgatattttcagacaatttctaatcatcaaagtcctatactcaacttacaggaaatctgtggttttttaaaaaatcacctataatttagtcatttagcacaaactattatttaatcgtcttttctggcagtcttatagcttgcattttaacgtagtcactatcatagtatatgtagttttgtatgcttttttcttttcacgtgatccataataacattccttttatgtaaaatctctgaattcgctatgaccttttatgactgaggctttttaagttttgttttgagacagagtcctggtctcacccaggctggagtacagtggtgcaattatggctcactgcagcctcgacctcctgggctcaagtgatcctcccacctcagcctcctgagtagctaggactatagacatgcactaccatgcccggctaatttttgtattttttgtggagacagggtttttccatgttgcccaggctggtcttgaacttctggactcaagggatccacccacctcggcctcccaaagtgctgggattataggcatgagccactgcacctggcccttgttaagttttaattaacttttttgtttgtttctttttttttttttttgcgacagagtctcactctgtcaccctggctggagtgcagtggtgcgatctcagctcactgcaacctccacctcccaggttcaagccattctcctgcctcagcctcccaagtagctgggattacaggcgcccatcaccatgcccggctaatttttgtatttttggtggagatggggttttactatgttggccaggctggtcttgaactcctgttcaaatgatctgcccaccttggcctcccaaagtgctggtattacaggcatgagccactgcgcccggcctaattaacttttttcaataagcacttttctatgttgacttccacatagtctttattaccataaattaaatgattgtacattattcttttgacttaagtttaccatgatttatttactcattcttcccttcctcttaattttttttttttacatttaagttgcttctattttttgttattttaaatataatgttttgaatctatttaggtagataaccttttatttgggttagagtcccacaagtgggaatcctggttcaatattaggaacttttctgactgtttattgtcaattgtgtctcaaaatatttgtattagtttacaataccattagcaggatgagtacaaggtaacttatctaggacttgtaattaacgttcttgttagatatggtctttgtgcaactaaaagtaatgtgaatggtttgtcttctgtcaaaattcctcagactctgatcaaaataatagatccaaatgacctacgacatgacattgaaagaaggcgaaaagaacggttacagaatgaagatgagcacatttttcacatagctagtgctgcagagaggtaatcagtagatgacaaacatcctgttatcagggagctttgggttttaccatatttttacattttttgtgtgatgataattttcattttaatatagggatttgctccttcaaatccatcttatatgtttaagtgaaatctattaaaatgtttccaggttattcagtgattctcatatgcggtttgatttaaacaacaaaaactatggggtaggtgaatatttgaggtcttcgtaattctgatgaggagtgttaccacttttagaatattagcaggaggcaggaccagcaagtttacagactatttagcttgagctgattgaaactctgatacattctgccctttagattctgggttagtctttgaatagtagaaaatttcctgaagtcagtacagttatcttttgcgactctttgtggatgtctatactggataattgtgg

SEQ ID NO: 1138 - DNA, 553202 bp, mus musculus
ttttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccgccggtttagagcaccgctgccagcagccggaggagagcaatgcgggggcccgagcggcagctcgaacagtaatgtggatttacagtcgtttcccgcaggagtcggccgagacgccctaagtcccgggcactggcagcgcccggcggagccgagcacctggcgagggggcgggggaacagcacctggggacgccgccgaaacttgcgcttggaataggtaggtgcgtttctcctggctcccaccccattccttctcgctcccgcccgccacccccaaccttctaccccaaggactacaggcgaacttcgccccgaggctgcaggcggcggatggcggctcctggctgttagcggccggttgagtccgctctgggactcctgcccgaggtggcagagcctccgcatccttcttctcccggtctccgccggccatggggctctggaccatctggggcagaagggaggtcggccttgttcgcagttcaagcttccagcgggccctggggacgctgcccttcgagggctcgctgggcttcccaggcggcacttttaccaaccaactccttcagttctgagagggagcctcctcgcctcggctctcgcgcagagcccagtcactctaacaagtggacctgggtgcttggggtgaggatgggaggctcggtctaaaaagaaagaaaggggcgcttctctggcatccctcccaccctggagcgttcgcctggggctctgccactggggtccaggtcctgctgtctccgcagagaatatgcccaagggctaggacgcactttagtacctgtttgcttctgaatttctatttgagcctcactcagggagcccgggttcccgggggaactgcaggacctcctaacctacgccgccgtcgagggccccacccgatgcgtcctccctatacctttgtcaatctttgtcaaaagagatagtcattacaacccaggcggtgctccaggagccgtcggtgttgactttaaccatgcgctccaatgtgcgggtttgtgtgtttccgcatttcatccagagacttggtccccgagattcagcaacggccagcatatctgcgagcgccaagcacccgctaggcaggcttggggaaatgtaacctcactttcttccactccataacaggaggattgccaatttagtttcaggatgctttgcctagaggcggagaaggggagattgttagcgctacttggtgagtggatgtgtttgcagtcaggagtgtatttaaacatttcagtgaacccgatgcagtcagttgtttacaattgcggagacagaggatctcactccactagtagatgtttccacgtctgtgtcgccactgggagagtaggggcgggggcgggggctggtttgcagctcgtactcgccgtcggcagcttcgggttgagcagatctgcatcactgctactggcgatatgctaataggggtagaaaagctctacatctccaatatgaagcaattggtcagtaaacgtcctgaacttaaccgttgttttcctgggataccaacctggaggtgtttttgaggtggcccaaagaaatacaaagagaagttctcagtgctacagaaaggaaattagtagccatttggttttaaagaccaaaaggaaacgaaacatcccagtgcactctaataggtactgttagattagcgtttaattgatcgcgtttgtgacgagtaagtgtcgcagacagcttccttgaattttagactcttgttctatgattataattaacaagccaggtaacaatgtactgtgagaatcaattgctactcttaacgtgtttgaggagaacatggcaaatgtctgctctattatattttttggctgaaatagcccagttcatcttcctagtccgaagtcttctgatctggagcagtagatactccagtgttaccaagaaagggaagagtctaagagggaaaggcttaaaaaacaaaattaatgaaaaggcgatccacacctttaacttctgctccatgattacccagcatctgcttgcttgctcacccccgctccttgctcttcatatctgcaacgtggggaaaaatgaattttcataaggcatagtaagaccctcaaagtacataactggagaaacagaatcccaattttgccattttagttcaagttcataacactattttgtgatgcattaaataatttactatggcaaagttggggtttttaagagtaattaaaagctttcaggtatgacaaaataatgttgaaaacttttcatgattaaagaaagtcgaaatatgcatttaaaaagggatcaggtaattcctaaaataaatccatgctctaaatattatttaaaagttttcaggttgttccccagaatgtttctgaaaaacaggtgtttctataaaacaactctatgaagaaatgttaacattttcataataaaactagtagagtccagtcctgagaacaatgtcagctatacatagcagaaaaaaaccccacaaatatttttgcatacatgaagtagtattttccattaggtttaggttccaattatgaattagggacagtcatgtcatttgacaaaatatacagtgaggctaaaggaaagaatgctttgtagaatcattgtgctgtaaaggtgattaagatttcaaatattcaaacgtttaggtgtattaaaataaaattgtattatacataactatcatcacattcaaaggcctaattcagtctgaataccctagaattctcagtgtttcaattcagctattatatgtgtaaataacaccgacataatcatagtttccctcatagtcattgatcctttctgatacctttaccagaaagattcttgctgaagcagaacagtctagcattcaagtttattctatacaatattactttaaattgtcaaactgcaaaacattcctgatatgttgtttctgaaaacagaaaacttagtggaaatttattttctgtgacagccttaaaaacttggaagtagtaagaaattttagtgttaattaataaaacaaacatttttcatattctatgttagagatagacatttggagtccatataatttttgcttgaagcttgcttttcctaagtcattcagtttcagatttaagtaaagctatcaagtagttggtatagattatggttaataaattccctaaagtttcccaaaacaagttaattattattatttatgcatttatttatttacttacttataaatgaccagaggtcaaaagaagaccagtactttgaataactgagtcagtgattaatttttttgatgaaaacaaattttcttatagtactcatatttgttctctctctctctctctctctctcacacacacacacacacacacacacggaagcaattgcttgtgaatgccttgaatcagatataaaacatgtacaatagctttattaaaattatatatatttgttaaattgctgtggattttaaccacaaaattaataatccatgcgtacttaaaaagcttcccatcacttaacatttagaagaaaggtttaaactggattcctagtatgactacaggcagatgaaaaatattgtaaggtacagaatttagcaattgtgaccaacagcatatacccacgactggaagtgtaactgctgattataaaaattaaaaggaatcaaatttcagaaatgctcacatataccacaatttctttaaatcttctacagcttctgagtgttagattaaatcactactttgaatggagattgctattatttttccttcccctaaaaggtaaaaatattctgaatcctggcttaatatattatttttattcctttctgttttccattgattttttttagaacagaggaaagtaaatatcaaatataaccagctagaaccatgcttagtttgagcaggtgaatgctataaaaggcttcacacagcttttaattattcttaacaaccttgatgaccaaccataggtgtctgttcagtattcggtgctctgttatggcaatttatataatgtatagagattttgtagtttgctagacgtgctgtggtacaatttagcaagaccagcaaaattgcttacatttggaacccatgaaaaatagggctgaggaaattggaatatgatggcatagactgaaaattattatataacaatatttatatcaattgcaatgctaacatttctgtatagaaattaagctaatttaaatttgaaaagtaaatatttttacaggtgacatggatccctaatattttaaaatagtaacttagagtctaataaatgaagtctattagatttttatgtaacttcaggacccatttcaaggcctggaagtataatcttggataatttacaacttaaaaaattattctaaattgtacttcctgtccgagcctccactttaggtaaacaatagcatatggtgaaacatgcatatatgccaactaaccactacctcttggatgatgtttttaatgtgatgtaatgattctgaaatattggattctccacccccgctctattctaactgtaagagtggagaagctaattggaaaatggacacataaaaacatgttaaaaatctcttttcacatgggtggataatcccctatgaagttcttacctgggagcctttatatttctgtttatggtagatatgtgccaaggttaatactttttctctgggtgcttatgacaaatttctatgactgaatctaggtgacacccaaatatgtgactgcaccattctgttaaccatccaactgtttggggtgaaaaacatctggttgtttgagaaaattgtttacctagtttctgggtgttttggagtcacttaacaggccgatgacccttaatatccatgtcaaaagagaaagaaaaaataaaataaaacactttaaaatacatgtaaaatatcttaaacactcttgggttactataaaatgcccaatgaactaaatgccatcgtgaatctacagccttctataaaatgtataaggagatgttgcttgcattctacaacaattacagaaacagaaacacactgaccttttcagcaaggcaggaaattaaaaactttaaattcaattctacaccctactcccccttccctgcccccacccctgcccactgtactgattcatcagcttaaagaaattgacttaaggggcttgatacagtggcttcttaaaatttcctgtacctcattttccactgattgtgctactgccatggaaactagatgggacagacagctgggagtcactaattcagaatgggaatctgcttgttaatttaatttcatgccagcctgttggtccctgaaagtaactgctgtaaaaggctggggaattgaatttgctagaaataaatgattaagctgaacgaaaaatcagtgccatctctgtcattttcctgaaaatcttcctacaaccctctttgtccctactcaagcaatttttaaaaaataatcacagaaagagaagtttgatttgtgcattcctattggtatgtatgtattctatggagcattttttgttctaatagaacattcacagctgtaaaatagtttcataatagctattacattgaaaaaatatgttctttcaaattatgattttgtagactttgaagaagcctagttagtgatgataggaaaacataatataaatgatgcttgaattttccagtagaattggttatttttccttttcaaataaaaaaagtcttattacaatatctatgtcccacttttattacagagaccaaatgcatttgaatacatttatttgaaatttgtaaaacagtcattttaccagtcaccagaaagcatactggttgttttaattttattcgactaagttgtaaattaataagtagtcaacaatgaggaaattgccttttaatgtttctcatattctgttgtaatgtttttgtggctgattatgagttatgaaattaaattttggaatcacaatctctatgatgagctgaattgcaatccatgtcaagtcttttgcaataccggctaaagtcctgagaaactaatattacttttctgtcaatttgtagctgtaagcaaatttctgtattacgactgagagaagatctttgataatgaaacaaagaatggaaagataaatatatgtaaaggtcagaaggtatttttctgttttaaagttaataaaatttcaaaatatatatgttcaaggtagaactattaatgatagaatgaagcagttattcaaaagtttaggaaaattaatatccacatttttacagtttagggaatactgagaatatcagtatccagttgttgagtgttgaattacgtgtattttattctttggtgtattttttgttacttggactatatctgtgtgatactaaaatctgactaaaacttaaaaaaattgggacaattatcacggaacttgtagaattcataatattggtatcttctttgtcatgtcgatttcctctaacctttcagcagatgcttgcatttggatgaacaatggaaaaagtcattcattcatctggatggttccagcttccactgtttactcaaatcctcagtttttatggttctatagcctcggtttcccttttgaaatcaccatatatttatttttcaattgtttttctatttagttgaaaggtgttgtaagtattcaggatgctgatgcatattatacatatatatgtaactttcaatagaatttctatgcatttatattaaaggaaatccactttcattttaatgttttaaggtttggaatcgacttagtgtttttagttgcctgtatgaatgatggtttttaaacagccaaaataaaagtacgtggctatcagtttgcatacttctgggaaaatctgatcactggctaaggtcaaagagaaaatttcccagttgcatggttttgcataattggtggattctaagtgtgtatattacctctaatgtctctatctggtttagacacctgtcaaagagaaggtgccagattagatggacaattggtttattagatattgcaatccctatgccccagctgcatacagacattttaagaaaactcttcagttgttcagagaaattagaaagagatactgcagatggcttatctcaataatccaggtttttttcaggtacatttaaaattaaatgtcctaagagatgattaattcaggaaagttattgataatgaactaatcttatgctacacatcctttgcacctatgatgataccttattaaaggtgtttcaatcttgctaattaccacctgtgtttaaatatagaggtgtataaatacactataactacacagtggctggaagccttctcaacctaaaattttggtactgtttttagcttactcaattcctatcaacaaaaagtttgtggtcaacattttgaatttaaactctgtgccttatccccctcctgcctttaacattaatgattttctttttttaagctgctctgcttaattgtaagcatttgagtgatactgatgtgtgatctgttctattaagtagcccaaaaatgtgtttgtgtttatgtgtgtggggctgacactttttaaatgaatatttatgaaaacatacatacattgtggacaaggatttcataagcatcatttacagacacatgaatacatcacttatttgcttactttatacttcaaatgaatatgtttttgtgactgtgactcatacgcttaaagctttaagcaatgtaagaaagcatttcagaattgtgaagcaagtcaaaaaaaaaagaaacttttttggggaagatagtattaatttcactaatgagatctagtgaccgctaagggagaagaacagtacagttgattggccaattaatacttattgcttagacttgagaataatcttacattttaaattatcaataaaatcactctaattccttccttccttccttccttccttccttccttccttccttcgttccttcttttcttccttccctccttccttctttttttcttctctttttaaactacttttaaggtttgggttggtatacagttttaagagaaaggaaataggctttaggacactcactaaaatattgggagcgattactctttttattcttcttctgattctggccaattctttatatatgttccagataattataaacataatatgagatattattatttatatttttttcagttcgtaccttctttcagttatcttgggtaggggctataatgtcacactgctttactgggttggtatttattatagatgtactctgttcatgtattcatatgctgctagtacatttgtgatatatctttcctgtttagtctaataaaatcgcaacacttaggtgtgacaccatttatttttggtttagaattcatgaagtgtcaacataaggatgctacattttcttcattgttttgttcttttcactatttgagatattgctttgatgaaacatcggacaacttgtgaaagtgaggtaattttaatgtaaacaattagagttcagtgcaagggaagtattttaactggtaatttaacatggaagagagaaagttttaacaatttacttctgtaaaacatggaataaagtatccttaagaaaatgtgtaaaacagcagtagacatagtgagagaacactggtcccagatatttagcaaaatacttggaactgctttactattgaaagggaaaaaaattaacatttacactgatgatctgtgacaatgggtcttgaaggctcctgttttccacagaggctctccaggtctcatgcactggtctctccttttactgaaaacttcagtttacatacttttggttatatatcacagaacaattttcatgaaggaaaattttcatttgctcattcttccattcattcatttgctaatttatcaaaccttcttcaaagcctctgtttacctggtgctacagagacattaaaaaatcatctttgggagacagatatataagcatactccggtcatataacaaatgctatagtagaggaataattagaatgctctggaaactcaaagattgatatagttttataaatagtcagttatttgaattgattcttaaagagtgtctaggatgttttttagtcagagaatatggagaatcacattccacatgaccttagggctgtgaaagaacactaggttaaattagcaatggggaataccaatctaggacaagagagtgccattttatttcctatccgagcctggggaacagaggtcagggataacgtcttatttccatttatgtgtctgacatacagaagaggcttagtacacatttgttgaatgaatgaatgggttggtattttgctgcatggagataatcctagaaaatggtgtttttcctgaggtttatccaaaattaagcagtgtgctatgttgtagtagtgtcaactgaacgagataaggggttttaaagtgagggcaaggtgaatcaaccttgtgttagaaagacatcaccagtatggaggaaggattgaagtagattaggagtatagtagcagtgagaccaataaagaggcagtactgcaactgtgaccaattatgaggacatgaaccaaggcagtgacagtaacatggagaggagtggacaaatttgagaagcactgataaggtagaatcaatgattctcggaaattgatttaatttagggtgtgaggaagaaggagggagtgactctgaggcttttgtcttgggaaactaggtaatgccatgaagcagaatagggaacacagaagaaaaagttggtttcagtggggataatgcagtcaggtttggacttattcgatgtgagacaccagctagatatccagatggagatggattgtgccagatggaaattacagatctggctgggcgcactggttcctgcctgtaatcctagcagcttaggaggccaaggaaggaggattacttgagcacaggagttccagacaagcttgggcaacatagtgagaccccatctcttttttaaaaaaaaaattaactgggcgtggtggtacatctctttagtcccagctactcagcactctgaggtgggaggattgcttgcttgtgcctgggatgttgagactgcaagtgagccatgattgcaccatggcactccagtctaaatgacagagcaagagcttgttctaaaaaaatacagatctgaagataaagtctagaattagagatctgggtgtcatcaatcaacatagtagttgaaatcgtaggggcaggtaggtgagcttagctagagagtatatacagtcatcttttgatatctgtggggaccaggttacagtaccccccaccatagataccaaaatccacaggtagtcaagttcatgatataaaatggtataatatttgcatatgacctaagtatatactttaagtcatctctagattacttaacaatacctaatacaccggacgcaagggtgtacatgcctattgtccgaactacttgggaggctgaggcaggaggatcctttggtcccgtgagtttgagtccagcctgggcaacatagcaagaccccatctctaaaaaagaaaatctaatacaatacctacacatcactttattcacatggattcaacaaagtacttgctgtgcagcaaattcaagttttgcttttgggaactttgtggaattattttccaaatatttttgattcacgtttgattacatctacagatgtggaactcatggatacagaaagttgactgtatagagtaaaaagagaagcaaagatgaaatattgagaaacactgcatttaagagtttagtgaaataagaggagccttcaagagagaggaagttagaataagatcagagaggtacaagccatacaagataacaagaaaatagaagctaagggaggaaataattttataaatgccatttgggcaaagacatgaaaaaataattcacaagagaggaaatagaaatgggaaatggaaaaaaaataactgaaaaaaacctcaaccttcagtaatcaacataaatgatattcagtgaatataaagtttctcttatgcaaggcaaataagttctagagatcttttgtccaacatagtgccttaaataacaatactgtattgtacacttacaattttaagagggtagatctcatgttaaatgttcttaccacaatttgtatgtacatgtatacatacaaattagaaacaataaatgcctgtttattttaaaaattaaaataatgctcagtgcaatttttcaagtcccaaatgttagtcattcttgatttctcttttttaacacctgacacccaaccaattaacaaatgctgactctaccttcaaactatattctttatctgaataattttcttctcattcattactaacactctagaacaaaccaccatcatttcttacctggaatactgaaacagccttctaattgatatccctagatccatctttgttctcatatagtttttcacacggcaaccaggatgatcattttaaaacttaaacaagatcttatgatctgtctgctctctggcttccaaaggttgacttctcaccacactttaaaaaacttgaaaaatttaaaaaatctttacaatgccctacaaggctttacatgatttggtcactatttattggacttcatgtcttgctatgtcccccctcaaacattgctcataaccttctagccatattgccctttgatttgttctttaaacatgccatgcattctttttttttctcagggccttgtgcctgcttttttatctgtctaaaatgatttttctccaaggtttctgcagactttacttttgttttaaaataaagaacagaagtttattttctcacagttttggaggctgggaagtccaagattaaggcactgacattcagtgcgggaggcagttactccttctgcttccaagatgctgccttcttgctgtgtcctccagagggaagtaccctgtgtccttacatggtggaagttgaaagggccaaaaaacaaaacaaaaaaaaacaaaaaaaaaacctagcttattccctggacctcttttataaattaccaatccattcatgtcttcatcacttcccaaaaggtcctgcctcttaatacggttgcattgggcattaagtttaaacatgaatattggaggggacataaacaatcaaataatagaagtatatgatagatcctttttgactctttcaggatcacaccaccataataatgtcaccagaaaaggtgaatggaatattctagcattacaagtaataataaaaactaacacatatggaatgcttcctaggcaaagcactgtcctaaggactttatatgtattaacccatttaattttcattcagacctctccaggtttactttcttacttcattcagatatttgatcaaatgttccttcatcatagtggcctactctgaccatcctatgtaatgaactttattgtctttcattttctatgcctttatcagcttctatttttctttatattactcatcattaactggtatcatactgtatttttatcttatccacttttctagaatattagttccttgagggcatgaattttgtttcttttttgctcactactatatccatatcacctagcacagtgcctgatacatagtaggtgattaataaatattggttgagtaaatgaatgactaataaggacatgatgaaatattagttggtgtagatttggcagtttgctgcaaaagccttaataatgttcataccaataattctacttctgggactttgtcctaaataaataatatgaaataaagaaaaaacttcatttcagatattttcaccaagcattatttgtgataatagaaaatatgaaggaacccaaatgttcaacaaggcaaatgctatgtgatttatgatatatctagacaaggcaatacataatggccattaaaaaaagatgtttacaaatattttaagataaaaggaaaatgtttatgttatactaccaaatgataaaccaaggtgtaaaattatatgtatccaatatgtaagaaagaaaaaagacttgaaaaagatatgcaaaagtgctaaaaatgattatttctgattgaaaaaggtgggtaataggtcattttttcctttattatctgtattttccaaattttctgtaattagactatataactatcagacaccgtgtatttacaaaacaaaaccattaaaaaaacaaaaaaataaatattgccatatgagaagtgaggtttgggaacaaataaacaaagataataaacccatttttcttgagagatgttgctggagggagaggaatatgccagttttagccaagaccaactattctctgactttattttgaagaggactacagaagggaaaataatcgagatccactgatccaatctggtcttcactcactagagaaccaaagagggcggaacttaccctgctaggatttgaacaggatgttcaagggaaattgcacaaattaagtcttgttcatattgctgtggaaagcactagcaatttgcttcatgtaaaacagaagtgattactcactatatttcttcatgtcatgtagtaaaaacaattaaatgaagttagactatagattacttggctattcagccacagtcacctctaatggaaaagaagaaaaatagcattgacaagttttggcaggtctcatcattagaaatgcctatattgccagaaagaaaagaagcttcagccaataatgtaaaccgagaagttctctaggccttgaggaagaaagtgacaatacagagtgttgcagcattaattgtctgagagcactgatcattgtaatgggaaaactgtctcttttattaacacgattattttctgcgaagtctttgagtaaacgtcccattaaaaaaattgcattaggagtttcaaagcatatatagcgatgtaaagatatactcattaataagataaagtgtgacctatatgccgcccaaagtcccttgaaaatagaaatagcattaatataggtattaaaattacagtataatcaggtaattatttttaaaaagtaaaaatttgtaccattttctaaactaacagaaatcatacttttaacatctatttgagaaagatatctatccatacacatgtatgcatattcacattatgtgcatattcatatatacatatattatttgatgtcaacatcttgaacccggcttttaggcccttcttctgctcacctccaatttatgtattttacctccatagccaatctctgctgaccgttttgttataagaggctgagaactgaaggaagtagaatattattatctatgtaggaagaaacaacaggcagtggtgctaattaaggtctgggctagatgatctcttaatgagctgtccaggtttggacatagggctctgcttgcagggtctagcctatctccaaaaccaatagtcagtcctgtgagatgtatttgtaacctttgtttaatagcttctgctgtttttgcctctggtatgcattatttggctgagttcagtgatggtcctgtcaaacattctaatttctttttcttaaacggtagttagcccacattcagtattaagacagtgaacagtttattttttggaaatgaattcttgagtggaatagagagataaagggtgagggaagttgtacatgttgggaattgttcagtgatggcaagtaacctgtggtatctgacatagatcaatgtattaactggccttctctagtcataaatggggtgacacactcctaaaggaaccagcttgaaaacaatggagaagtgagcagagaagagccctttgtttttccccagtcttctgtttatctcaccaaggcaaaatgctacatatagggcagtttattttttaaagcattttttgctagcctccttgcagaatcagcctgatgtatatgaagccaatttctacagacttgctctggtatatgcagcacaagagccagaaatattttttgtagtctggatctaagtactttctgaaatgtcttcccttgaaagattctaacttagcactattctggaaccacatgaacatctgagcagaactacgtcttttttgagcaacattaacagtgatgaaaaatgcacatcaggcagttagattgcaactaatcaagagcaccacttcagcctagtatgaatgatttatatatagtgcattggatatggagatcattagtaataatatgataccctgttgtcattataaggtcaccttggtgatctttgtaagatatttgtaaggtgacaatgatgttactgaactacattttaaatatggcatttaagtattgtcttctgtcttgatttactggtaaaaattttaaattgtttactcttactactgagatttttcctcaaatataaaaataataggtttggggattacttcattaataaattgggaccataaggttaattaagtgccagtcataaaatattggaatgttaaattttgaagtttcttttttcttctgctttaatttacacactgccttttcttttcttttcttttctttcctttgttatttttttagagaaagtctcgctctgtcatccagcctggagtgcataacactccagctcactgcagcctcaacctcacagctcactgcagcctcactgcagcctcaaccttccaggctcaaatgaccctcccacctcagcctccaaagtagcagagactacaggcacacagcacaatgcctggctaatatttttatttttattgtagagacaggctttcattctgttgcccaggctggtctcgaacttctgtactcaaacgatcctctcaccttggcctcccaaaatgctcggattacaggtgtgagccaccctgtgtggcccacactgccttttctaaaatggatttttgaagaattaaaaacatattataactttctatatatgagtaatatatgtttattataggaaagttagaaaatacagatacacagaaagaagaaaatcatataatttacatacatctatatctaagctcaactcacattgtggttactttataatgtgcttatttaaataaatatttttgaacatctttctatgtgaataaaatatatcagatatgtgcatacacacagacatatataaatacgtacacacacataaacacacagacctacacacagaaagagagagagagacagagacaaagagaaacagagttgaaagaaaacaccaaaaaatgaaaagaaaaatgtgtagtcccctttcccccatctcttccagaatgtcacttagaagcagcaaattaaagatatacatagaaattatatgaagtgatcattaacatctaacagttcccatattatgtttaatggctgcttagtaatccatcacataaataaatccttgatttatttaaccagactccaattattggatatttaggaaatttccaatatttattactataaaaacatcatgaaaaattcttatacatacctctctgtatatatctctgataactccttttgaaatgtttaaatgtaaaataacttgatcacaaggaggacatatttttaagggttttggtacctactgaaaagttgccctccataaatattgcaccaattttacattactaataaatgacttttttctcttttgtttttgagacagagtcttgccccgtcgcccaggctggcgtgcaacagcgcaatctcagctcactgcaacctccgcctccctgattcaagcaattctttgccttagcctcctgagtagctggggttacaggcacccaccaccatgcctggctaatttttgtctttttaatagagaccgggtttcaccatcttggccaggctggtcttgaactcctgacctcgtgatccacccgcctcagcctctcaaagcattgggattacaggcgtgagccaccacacctgccatgaatgactttttaaaagttcatatgttaaaaatccaggtgacttcatactgggtatatataaatcagaggaagaagtgtatctctcaagtggagtaaattagtagggatcattatataatagcacagctccttccttagcaccaagcatggcacatgggagactgtcttagtctattcgtcatgccataaaggaatgcctgaagctgtgtaatttataaagaaaggaggtttatttgggtcacagttctgcaggctttaaagaaacatggcaacagaatccacttctggtgaagactcaggaagcttccaatcatgtcagaaggtgaaggggagccagcatattcagagattaaatgatgagagagagagagagagagtgtgtgccaggcttttttttttttcaaccagcatttctcatgggaactaagagtgagaacttacttgcatgataagggcaccacgctattcatgaaggatctactcccatgatctaaacacctcgtaccaggccccacctccagcactaaggatcaaatctcaatatgtgacttgtggcagggcgaaaccaaccatatccaaaccatagtggagacacattttatagtcagttttatacctgttgaataaaagatgccatgtgggacgttggtaaaaggactgaaccaaaagtgaggggacatgaattctaatcctggctctgccactaaccacatatgtgagtttgaaaaagccatttaatctctctgggccttagtttcctaatcttataacagagttgtttgagaaatagatgaaatacatatatgattttttttataaattgtaaaggacaattttaatgtaagaaattaggactattataaattgtttacactagtggaaactttgaaattgtgggcatttcatctcaaaatgactggtatgttgagtgaaaattgaaaaaaaaaggaaattgaatagtgttcagttgagagagtctatgtggaatgggtgagaatttcatactcctccaggtatactcttctataattaagaaattctttgttagcagcatacttaatataatcagttgaaatttcaagtagaccttttaaaaagcggacccctttatctcttgtgaattgcacaatgaatgttcttatattcacaaccctcatctccacttccaaccctaccccacatgtatctcttccattcgttcatataaggactgctttggatttgcatgcacatatgtttgaaggataatttggcctaatttgtttacaggaattacaagggtgacctttattccgctgtctcctttttgattcccataacttctggacctatcaaggtatgtgcattttacactgaattttactttgagaattgaacacatagctacataatgtgaaaagaatggaatgttttggtgatatagtcagttgtatttattgcatgtcatgtaaatgaaatgcattgttttaaaatttttaaagtctatttgtccattttatagataagcttgtgtctgtacctcataatttttagtctttgcaaaaacaaatatgcaggctgtcttacatgtctgaataattctgtgaccttttccacatacagctactcaaatcaggagtcttcttaactaatgggaacatctgcagagtgtgtaggaacagcagtagccagagaagatgtttgcaaaactatttagtagttcttactgactacaaataaatatttctccatatcaatggaacagataattccatttagaaaattttactggcataaatatttgcctcctgaaatgaatgttttgattctttagtaaagtctcatgtaaaatatttgtatttacacaggtattgcattcatttgtttacccttccgttctaccctctcttcatctacccatctatctatctatatatgtccaataaacaggtattgagcaactttggggcaaaagttattgtgccttttttcgtggtaaatgtgccaatgtaggtataattcaaatggagctttgagagtgtttgcttctctatagtcagtccactgttaggtggactacgtgagaaaatgtggcaagatgaaggatctccctcattggttttaatttttattaaaatattggtcaatgttcagtccttagtaactaaggcacagaaagcattgattttttttccctttgctacctatatcttgcagtgctatgcatcattactcaaatgtgaattctcatttcaagctgtaaaaaagtcaaaaggatgatctgaatttgtggtaagtctttggcatcacttgatactttctttaagagtatgtaaaaaagaaatctgcaaactctcagaatttgcattgcccttctaaaaatataacacaaatatctcattaagggtttccttaattgggctccaattattggatattagtctgtatcagaaatttaaaacgtatttgtcagttttgactatacatgtagttctattagcctttctttcagaggtactgtctttaagggaatactattgccaaaaagttcagattactataggaaaaaaaatgtaagatcagaaaataaaatgacattaaaagataaacttacttaaaaagtaagtcgagattttgcatataatgtcatttgtgaaaataatttttttaatttggtaattatgagtctgccagttgtgcaatactaattgcaaagtatttttcacactaggaaagtttaaatgtgtggaaaatgttagtcttactaagctaatgtgaatgaatggatcagaatggagaggaaaatgcctgacagacccaaagaatgcacacttataaaaataattggcactaaatatttaaaagtttcagagagcagctagtttccctcttttagaaagacaacatgacatagtagaaaagcccttgtttgtcaatcaggaagcctgggctctactctcagtcttatattagtaatacgtttctcatcaggtcacttcttcactctgagcattggttttctcaagtctattataaaaactttgggctgaacaactccaactgtctttctgttcaaacattgtatgatttttagaaaattcagggctgttctcagatatgcaatacggaatcaagattagcaattaaattggaatacacacaccatttaaaagattgctccttgttaagtggtttagtgagttggtaatagtatatttttccttgatttaaagcaattgtgtattctaatgccactatcactcactcactccatgcgtactagtactggcgttataataaatagtttcaagctgaagtttagctagtagtcttgagtcttcttccttgataaaaatgcttcactttgggatgctgctgtgcttcttctctgccagtctgttggagttcagcaaactatgttttcaccttcttgcatgatggtcgttcgaggtcaagcatctctctgtaccttgaaaccatccaagtgcgtaacctgatgacttcagactccaatgctttcaatctggcacctttcatgagcattgagttcatattaaaacatttaaaatatattctccttcatctacatatcacagcagtaacaacttgggcacaagacagtgcctgagaacaaataaccacttggagttaatgatctgaggggcagctgaaggaccattgactcttcctagtcagttctttgtccctataaaatgcctacttctgaggtgccgagccttcagtaatttttctgtctcacgtcagattaagtagtgaccataaataatagcatttaatacataataatgagatgtggcaatgcaataaaatatcaacaattctagtactatattaacatggctattctgatgaaaccaaaagaatgagcagtaaatgaagttcatgaatcataatattttagaagagactttcaccttattgatttgaaatgagatataagaaagaattcatttggtttaggggagcagttccctttcttttgctctgcattccactgatgaatgatctaatttagaaataataaaaaatgcctctgacatctattttaaattgatttttaaatagtgtatgttcagctttttcccctcttttttagcagtagattcatttttcaagatatgtacagctctgaactaagttacaaatacaactctacaaatgttcttttccagaagaagcactttttatttatttattactgtgacaaacatttataagtctctacagtgtgccaggcatggtgctaggtgctggggaaacaaaaagtaatatggaacatagtccttactcataagctcatagtagagagttggggactgtgctatacacagagaaataaaataatcaagtgttgtaggtatggagtttctatgaatttacttgctcatggcatttttaaaataagtttaaaagattcatatatcaaaacctactgagtaaggcaatgatgtgtgtaatctaaaatagctctccactcaaatctgcagtaatcattggttatggtgggaaaaatgcccccccccccgcccgccgaaaagatgtctgtgtcctaatctctgaaacctgtgaatatggcatgtcatgtgaacatgacaaagaggaattaagattgcaaatggaattaaggttactaatcggctgaccttaaaatagggagattatcctggttatctctgtgggcccaatgtaactacaagcatctttaaaagtggaagaaaagaacaaaagagagaaaaacagagagatgggcccatgagaagaacttggcctgattttactggctttgaaaatggaggaaggggccatgagccaaggaaggtggatggcctctagaaagtggaaaagtcaagaacactgattctttcctagagcctccaggaaagaattcagccatgccgataccctgattttaacctatcaagacccacttcaggcttctgacccctggatctctaagataagtctgtgttgttttatgctgtcaattttgtggtaatttattacaacagcaatggcaaactagtacactgaggtttactcagtacggaaaatgtaaggagtagtctctagttgttgatcatgattactgaaaggcattcttcatgctgaaattggtgcacagggttatttacctagtgaccattttttctagatatccatatcaggtccctccatcagaactacagcgatttgtgaggtccctgaaaaacctggcaattctatcactgccactcccaatttcagagagaattcagtcctccttccctctccttctgtggaccacttgtgctccctcctcctatccccttgtcccatatccctccacattgatacctaggatacaaggtttgttgataagtgagaagtaaaaaattatctttttttctttcatgggacacccgcagcaggaagaatgatataggcactaatatcctaacaagttaccctggcatgggtttcatgacaatctaggtgttgggtattaagtagagtgtgaaattgaagtttcaagctagtggccgattgctcagggccagtcctcagatacgtttgtttgcaacccagaatgatttctctcctctcttctccttttcttcctttttaaaaatgctgtagcttgagtgtgtcctctttaattctgtagtagagggtaagtgcatatgctttggggtttaaaaccaagagaagatccaattcggccacatattgactgtacagcttgggcaagtagattaagaataatctctctaaatctcaatctcctaacctctaagatgagaataataattatacctcacagagttgtgatgttgaaaatggcatgcaaataattcataaaacaccttgcacaatgcctggcatataacatagtgtatgctcgataaatattagctattacttctgccactattcttgctatagtaagagcacaaaggatgggcaaacaatttcatctggtaggggggaatgagaagcagatatctggaaacgcttcgtggaggaggtaatgccggtaatactaggaccaggcatgtgagtgtggactgctggggaatagggaatggtaatttggtattgtcagatgaacaaatggtagggatgagaatatgttctaagcaaaagaataagtggcagagaaatatcaaataccctggtctcttagggaaactgcaatcagtctttacaggtagagggtcatgtggaatgtaagcatgagaagagataagcatagagaagtatgctggagacagatatagatggatttccttagcctgtatcctactaaggtggatctccttttttcctgtaggccagtggttttctaatgttgcttgtgaaatttgaagtttggtttattgccctctgaacctctttcttgcttaagggcaactcctgaaacagccacctaggaacactgatgattttatttacataaatatatattttttatttttatttattattatttttttagagatagggtctcactgtgttgcccacgatggtctcaactcctcaagtgatccttctgctttggcctcccaaaattgctgggattacaagcatgacccaccacacctggtggaacatggtttaaaagtcaccactcagccaagcacggtggctcacgcttgtaatcctatcactttgggaggccaaggcacgtggattacttgaggtcaggggttgaaaagcagcctggccaacatggtgaaactccgtctctactaaaaatacaaaaaaaaaaaaaatttcccggggggggggggggcacccgttattcccactaatttggggggtggggccggggaaaccctgggggccgggggggggggtttccatgggcccaaatttcacccattcaattccccccgggggaccgggccggaattctttttttaaaaaaaaaaaaaaaaaaagtcactgctctagggaaggaggaactagagaaagacgtcagtaatcatgtttgtgatatagagggcccacccaggtggtagtatggaggatggattggagggatcaaatatgaagaccaataaaccagttaggagactactgctaaaagctagataagagatgatgggggcagatggcaattaccaatggtgatagcaatgaagagacagagttgaacagtgattctcaaacttgagtatgcatcagaattacttggaaggcttgttgagaaacaaattgctggatcctacatttgagtttctgtttcagttggtctgaggtggggcccaagattttgcctctctaacaagttcccaggggatgctgatgccactggtccaggcactacactttgagaaccatgggatttgagatatgctatgtagaactgacaggcatgggtcacttattagatatgggcataagggaaaggtttctggcttgaaagcctagtcagatagtgatactattcagcattactaaaagcaagtttaggctgagttgaaaaagaaaatgttcataaccctagcaagagagggcagctaaaaatctttattattttttttttgtagagatggggtctcacttggttgcccaggctggtcttgaaattctggccccaagccgtcctcctgcctcagcctcccaaaagcaccaggattagcacctggcctttaaaaatctttaaacaagatttatgatcagatcctaggctttcttctgggcagcttgattctatacttttgtactactagcttctcttgctcccagtccacccccatttatatgccttggtgccattcacattccggaagtgaaagtacaactctgggagggggtagaataatggattccattttatacctgttgagtttggtgagccaacagaacatctaagtgagaaaacctgaaaaaataatttaggcattagtttttgtttattcgtttttaatttaaaatgaggtcatttccttatttcaggttggatattaactcttctttgtgcaaaactggagtagtcaaaatataggtcattttttttttttaggagatggggtctcacgctttcacccaggctgaagtgaatggcacaatcattgttcactgcagccttgaacacctgggttcgagcaattctcctgcttcagcctcctgagtggttgggactatatacatgagccaccatgccaggctagattgagctatcgtgcatatttcctgtcagtcctataaggatttttgagtgttaaatttgctcataggtggcaatcatcctttttatagtatagatcagtgaatccaaaacatgtttattttaaaattccccttgaacacccgtgtgacctagctttctctacgttacttccttaccaaaaaggaaaaatcaaagtatggcagaatatccatgtgggtaagtagaggaaaatagaagagtaccatacagattgacctttttcttcttttctttctttttttttgtagcttatttcagtaatggtcagatatttcactgaatctatctctctaaggttgagagtaggcaaaggaaagatcttaaaacaagataaagtacctacatgcaatggtgagatgaggaataatatagggaattttgaggagcagtagaagtgaatactaaacaaaaaggattaaattgatagacttgattttgttgcaagggggcagttgtactggtaaatcagtcattttgggcacatagtatatccttacaaatattctagcatattaaaattatcaatttacttgtcagcttgcagttccacaaagctgtagaatcatcttaatatggggagcaaaaatatgataagatggtcaattatagtcattcactgccaaaacttccttgaaaagatacacttaactgtatcattcattctcctttgaaggctgctcatcttagagactgattatgtacttgtaatttgtggataggacagccacccatacacttccatctgcaaggctcataaagaaccttaacttgtagactcaattcagtttcttgtaacatttagctccgatctttccaggaaaataagatgcattccttagtacttattcttttatgccagaaaaaaatatggaagaaaaacaactacaaaactaaaaacaaaaccttggggttttgctacgtgtttatagataagccatgatctgaaatgcatccatgtatatcaacaaaaagtccaacattggatgcttaggaaatgggatcagagttaatagaaatggctcttgtagtttcttggaaatctcactgagaagaagttattccttaggagtgttatttcagccccatgatattgctaacttgacagctgaatgcagaaatgtgtcttttgggtgaggcaaagtccagctttttcacagacctccatttcaccttaataaatttgaaatcactatttcttcagctttacatatttccaaagtatattgagaatcactatatatactttttttaaaggtaaagaaaaataaaaaacaatgacaaaaattctgaaatatgtacaaagggacaatataatcccatgccttgtggcaccatatctgaagtagcaagggtcttttctatagtatagatgttgagctggtgaccttcaaatattgtcctgttttcattcaatgtctgacatatgtcagatgaaactgttcaactcatatgactttaaatagctgttttctgtgaatgcatcagctacttattttgtcccagactcatctgtactactgcacatgaaatttaattttaaaatgtacacttcaagtgacatagttgagcatgtcactgtgtgtaatagatcactggttttgttctcgtcttatttgcaaaatgctcacctagttaaatggtatggctataatatgtaaacctttaggtgtatgatgtaaaccttcaataagttaatatcaataatacaaattttcaatgcctttcttaattttgtttaattttacacctgtgttcaaaaacaccctgattaatgctttaatattttgtatatggtgtatgaacacagaataaaagatgcacttatgtacatgcctgatccaagcttacatctacatactggaaaatgtgagtgccagctgagtaccagtttgcaccaagtttatagttttaatcataaaaaagtacatgaagttattattcatcttattgctgagcagtagtttgaaaaggcggagggagaagctctaagaaaatcctttagtaattctaagaaaggctggttttcagttaagtacatttttgtaagtcattttgtcatttggtaaacacacaatgattatgccttcagacagatgaaatatttattagaaagataaatgtggaaatcacaatagtattaaagaataccatgggagtgggaagcctgtcaagaatgttctgaccccaggaaaaagaaatcagaattgccatagagagggaccatagaatgaaaactttttaaaaggttatttccataaagtctgagaaaatcttggcctccattaagatttttgtccctgagagcctaaactgtaagtgtggtaactgctttgtctgcagaataaaaaaggaaatcttcgcttaatcattatcctgggagttgaacatcctgctaacatttgaataaaaatgcctacttcattactgatgggaacacagagttctgtgtaccaaatgatttacagtagagcttactgacagggctatcttacaaatgaatgggctttttaaagaataatacaagttgttaatgtgtatagtatcaaatgaaatatataatgcccacaaattctaaaaagtctaccaagtgagtgctggctgttagaaaaatatagtcctattatacatttaggtaaaatggaaagtgatgacatagaaaacagaattctgatgtgttgacaataccatcagtgtttttcctctagtaaaatctcttacaatgatggaaaacagaactatgaaataaccaagctgcagaggaccttgagaaatcatttgccctaggcttttgctttcaaatatgtgaatgtctacacaaagggtaagcaagtaatgtcgttagcgctatgaataccaaatcctttatttagcaaatatatacagcatttaactatgaataccaaattctttatttagcaaatatatacagcatttaactctgtgccaggcactgtgctaagcactctacaatagtaactggacacatttgtcatggtattgcttttttccctcttctacccctttttcgcctccccttattttttctctacacatcttttcctgtttcctttttctgctatgtggccctccttagtattgttccagacttcttggggtcctccagtataatgaggttactgaactctagtgtaagccctttattctcattgcttttgagaatgtcatggaattcatgtcaaatttgttatagaaatcaaagtagattattttatcattttgctttcatctctatgacttgtcattttatgatagaaataagtgttctcgaataatttggtatccacatagcatgcactgatagttacttccggtgtcataatatcacttatttaataataatattttttggataagactaaaattttaaagaggactgtgtatggaatatttttaaaataatactttctcatattaaatttccagtttgccaaaccacatgagaatcttctcttctgcctcattcctgaaagggtgaatatgctttcttcattttgtattttctcatctcattcttgagtttgtgttttttaatcttataaacttagtaggtctttagcaaaaactgctaaccttgctctttccacttatctcttgaggacatagataatcttaggtgactgacatagttgttattttaaattatagtagacagttcagttttcaagccactctcttccttatgtagacttctctgtgtgttgctcattgacttgtgtgtgcgcatgtgtatgatctagcaagttacgagcaattactgtgtgccaagtactacgctattcattttaaagtgttatctcatttaatttccacaataactttatgaaggttgcacagttatcatctccaatttgcaagtttagaacactgaggccaagggcagttaaagtaatttgagtaacgttacacagtaggtaagtggtaaggcaagtattcagggtattcagctactattcccttgagtcttcatttgttactaactgttaacagcataattctggtttctttaaatctgatctgttttctcttgtttagacatttaggacttcttaagttgaggtgtctgaatcttggattgggcctttagatatggcagatgaattttagactcctgctcaaagaatgtttttattgtggaatacctcaactaaaggattctaatgtgaccccactaaaacatgagtctggtagatatattttgcagtagaaagggccacaatatagtgaatcagtttaactccattttctgatatgccctaatcctttgcttacccatatcaccattccaagatgaaccaatttctctttgtctgatatcagtgctgtttacttcccatgaagcctccttgagtaaagaacatggacatttcttcctggcttattttctatttcttacactcaaactgtgaatgtacttgagatccattatttgtttttctccctctacctttttatccttggggatttcatctacctttataactctaactgctatttcttatataaataatttttaaaatatttcttacactatggtcccatgtctccaacctcttgccacacatgtacaattggatattctgctgatatctgaaactcattgtgtttctaacggtgagcacatcatatttccgaggttggatcccctgtccaacttcccagtttctgttgatgataccatcattcttccagctacccttgaggcttaaaaccttgaggctttcttttctttcttcttgtactttgctctccatatctaaccagtcattaggttccatcattgcttcataatgtcctttatttccatcctttattttctgtaccactgccatgagcttatctctactttagacagtttaacatcttactcattattcgccctctaaagcttagtatgtggccttgcccatagcagggattcagagtattttggttttgtgattgaggtgcaggttacctcctgcctccagcaacaatgagcacttttggaacccagcctttttgagtttatctttcttgcatgtgtgcatccatctctttggtagccagatatataccaatattcttttcaggtgtatatatttttgtcagactcagtgttatatacatgtctttcatgagctacaagagggaaggggactgaaattgatccagaattaatgagttccaatgctttaaaaggacaatcagggcattttatctagtgagggtgagacaataagctccatggcaatggagactatgtaggctttaacactgatggattcccaggacctagcactatacttagcactagtagtatttaatgaatatatgttgaatgaattaatgaataagctccaatgatagtgacaactgtgctgtcccaaaagaggagaacaaaagtctcctgacgacttgcctcattcactttaatatattaaactggggagattgcacctaatatgctgagatttttccacatggccatatatttaaggcaataattgaatctttaagaaaaatttatgttcatactaaattatatttctcgtgggataacatgacatgattctacttggacaccacaaattatattgatagggtgaaatgtgttttcatgtctgtttataaaatgtggaatattattgaattacttaaagtgttgtgtttgagatgagcttaggctggtttctttgggtttgacacatttcagtctgtcatcctgtccttagagatgttgaaaattaaatggggatacttaaataatttaatttataagcttgcttacagctatgtggtttatcaagccagatgtcggcaccctcagtttcttgcagttgagatgcttccagaatataaattaaaattggttctgcatgtcaagaattagcatgtaaaaaaggaagaaacttctttctcaaatagccaatatttgtgtagtatttgctgggcagtgccatttttttttaaccattagccaattttaagaaagagtataattcattcataaaataagcttaactatatttcggggaaaatcctattccatgtacatatgatgacgtaactcacatctttataacacaaaagtctataatagatatgttattctagtttcacgcctccctctctccagaagtcattttctgctgtttttcaaatgcagtagatttactcaagtttttatggttacaccgccaacatttccagttccttttttaaaaaattggtctagacaatattttaacaggacgtttttcctagtgagaaattatgcatctgagctcttcttcccccacataaatggaaaataaacaacagcttctatgtaatttaagcaaggctgtgggagacaacttgaggtgataggaacaatgcaggatggcccacattcaccgtgggaccttgggcaagtcaattgctctatgtgggtttgtttcttctcgtttaaaatgggggggggtgaggttgaatcatctctcagtttcattgcatgctctagaattctttgagatgttgtaaagtcttaggccacctctctttccaggttctttgcagtattaagctctttctattctttaaggcccgtgaaacattccaaggttcatgattccaacttgactttctcatttttaaaagtcctaacagcatttttatagtcagattgcagtatttagcatgtttatactgtataattatgcttgtctaattctctttatctagctctctaagtgttttcttgtccactaaaattatctttccaactggattacaagaatcttgaatacaggaactatgccttttacctctattttcttcatggaatctgttatattctaaagtaggtaaaagtatcaattgatttggattagattataatcacttatcacctgggttgaaagaacttgaagtatgaacaaagatagcctctttttatggtatattgaggcttcctgtcttagtctgtttcaactgctgtagcaaattggccataaactatatggcttataaacaatagaaatttatttctcatagttctggaggctgggaattccaacgccaaggcactggcacattcagtgtctggtgagggctgacttcttggttcataaagagccagctttctggtgacttgacagtgatgtgacttctcattgtattctcacatgctggaagaggtgagggtctctctagggcctcttttataagggcactaatcccatttatgaggactctgccctcatcacctaatcacctcctgaaggctctacctcctaatactatcacattgagtgttaggatttcaacatacgaatttagagtgggggcaggggacacaaacattcagaccatagcacctcctctgaaattatgaataatttcctctagatcccttaaattgaattaatattacaatgaaaaatactttttctgggtctttagatctcggggtataatttatgtgaagcaagtccttgtttgacaggaaggtgttactttggttattttttttttctggacctttaatatcaactttccaatctaattcagccaaaataaattgagcacacattatatgttaaaaattgtgatagactctgtggtgagttggagggaaagtggtgtgtgtaaagattgatagaaaataatttttgccctgactgcttcacagtgaggaatttgggatataatagatacaaaaaccaacaaacaaaataactcctacaatataatttaataagaacagtaatagaggtagatgtgaagtgatttggaatcacagacaagaaagcatcttactatatcttatggcttatgtctcggaatatactactcaaaggtaacaattttagaaaatgactaggaatttggttatcagaaaaggtagggaagcgcatcctagtaaatatattaaagtaaaagcacaaagacatgcaatatatctgagagattatctgatatagtatagtcagattacaggatgttcagggaaagcatttcatgagaaggtattggagtggtaataaggtttttagcttatcactgaccttcgaagtccattttattccctagagggtatacacccttgagcattttctaaatgtgaagaagcccatagggtgggagagctggtctataagaggaacttgcgcaattattttcttcctgtcgtgaaatcttcagaatcaacttcttcaactgtcctatatatttaagacagtcattttttgttcttttctcttgaatgtgtattaggaatggtgagatcgtctgaactcattttatgactaattaaaataggggaggaaacccctgaatatgcatctgaaactgaactcttacaactcacagcagtagatagcaatatagacaactgagactacattgcattcaggcttgaatacaagaagcttattcagcaaagcttggaatggagacttctctttctggtgcacttttcgagtatcagtggtggatgtctcttattcccttcaggcaaccaaggacttcacatttatcctctttctttgtgtctactcgcttctccctcaaaaacataaggcctgctctaagaaaaggaactgacgaacttagtcatttggaaccataagtgactcttaaggctcagtgggatagtctcccagtgctgtttgcattttaaggagataaaggccttgcttaacttaaatcacaagctttaaattttacagcagcacctagtccaatgagggagacatttggtatcttatcttaatgataggtactaccccaacattaatagcatgaaatcactgataacacttcatgtccttttatcgtgtccaataatattaagctatttgaagtttgataggttttgcaactgaaatgagaacctacagctagatttttataataaaaacagtataaagcatttgaatttctatgttatttcccacacttactgtttccctttatagtaatgaatagaccaagccaggcataaaaagaagaatgagaatgaaaaaaaaaaaatgaagaaatgactttctgggcctttggctctttcctatgggaccttaatttagacttctcttatatgtttctgagtttaagaaactgacttttgattgacaaggatattgttaaggttttgaatagaaacttagctattgaaagaattgtatcttagatgtgcagattagggtgggttcagggtagttagtattgagagaaaatgaagactattaaatgtatctgatggtcagatataaactagatatctcagttcctttaaaagcaaggccaaagcctgactgtgcagcaaattaagaaagaagaaaattactctgatttataccagccatgtgtggccaccatagccagtttgttagcccgttcattggaattggatttctgagttatttatttttttcatcctacattattgccatctttaaaaggaatggggtcatttttcagcttcatgcattgataagtaggtatacaactcccactgtttttcatatgtgtctaatttttgccactctcctgacaaatacgtgacaaaacagaagtcagtatattgctttttactttctcagtagtaaacagctttagcgggagttacaatataatatctagtgatcataagtagaaacaatttatttcagcttgcaaatattcctggggtatacatggctgggcactaggcactgagatagaggcaaaagcaaaagatgtggcttcttccctcaaaatgcttaccctctaggataaaaaatatgatctgcgtgcgcacacacacacacccacacacacacaggagatactggttttctgtggctgtgtaacaaaccatcacaaactaagtggcctgcaatgacaccaatttattatttcacagtttctttaagtcaaaagtctggtcatgacttagtggtttttctgctcagtctcgcaaagctgcagtcaagatgtcggttgggcttattctcatctggaaggtcaactagggaagtgtccactttcaactccctcagattattggcagaattaatttctttgtaggtgtagaattcatggcagtttgtttcttcaaagctggtaattgagaccgatagtctctgctgcttcaaatctctaattttgggagtgactttaacccccttttaaaggactctcttgattaggccaggcccacccaggatgatttctgattaagtcaaagtcatctgactggggctctaatacaaatagaaaatccttttgcctttgccatattctgttgggtagaaataagttataagttctgcccacactcatggggaaggtattacacaagggcaggacttagtgagtgtcatactagaatgtgtttgccacacacagaaaacactaaatacaagcaatgacaatacaagtaccttggtatggacaacaagtctaaatggaaagtatgtacagggactgaggaaacacagagcaaaagggtgatctctgcatttatccagcaagtttactatgcactagccatgtaccaggacctgtgctaagctctgaggctgaaataagtgcaaaatggcaagtgccctaggtaactcttgaaaacatacaatgcacaattccagaagacttcagaaccctattaaatactgttatctgagaaagagacactaaagacacagatgatgataaatatgtttactcatagctatgagttccttatatcttgctgtggaggtacaatatgacaaacacacagacagacacacacacacatacacacacacaagcatgtctacaaagcagtataagtaggtttgactgaatataacaatttccaaatatatcccttgacacaaaatcatgattgctttattctggcctctttacttactttgtgtggaaggtggaaaattgtaataatcatggccagggtttggaggtctgactcttcagtctattcaattagtgcatgtagatagcaaagcagcttctcagtttagtcgttgcattacatatcacttaatgtttgctttaatctttttctatttattaccttattggatctgaacaccagctctatcacacacacacacagcaaaatttaccgtgcccactttatagagggatttcttgtccagatttagataagcaggatactgaaaaacatgggcgaaaccctaggtcttctcacaccaaatccagagttttctatgccatgtttatgaattaacaagaaggaagtgaggtggaggaaaaaaataatatagaaaacaaattatccagcttcactagttctaccacatataagcttgaccctctcattctgtgtttggtggatcctttgtccattgttcatttttaagccccaaatcatgtaggctagagttctttatgaagccagagtatttatactcaagagtttatgaaaagttgttgtccctaaaatgtaccctcagactcacctagagggaccacttccagtgaataggttcttcgtgccccattagtttcttgatttctctactgagagtgcaaacaagcttcctgttttcacaatgattgtaatgatgtgaacatttacccattgggaatgagactgaaatcaccaaatcatttcatatgggctattgcacaattgacagttatgataataaatgtcaggacactgctgactgcttgttcaaatctactttgggactttttagttcatccagttttcctccagattttatgttctttctattattcaggctacttcaggccaaatatttagtcagtttttcattttgtagccttactgtctgcatccgggttttacatagtatattgaagagactgcttggtcacctaaagctgctccattttgtcattgggaaagcatgtcaggcaataaatcctgaaaagaatgaacgtttgctttatataggtatctcataatccaattgcaaagtctctctcaggaatccactgcaatttttgttttctgcaggtgaaattcaatgagataacaacagtgccatatatgaagccataaaccaaactccttataaggatttgattaagaggaagaaggaatttatggttccaggcttttagataccacctaatatgcaattttatctgtcttcaattattcataagtcatttcacagacacattaagatataccagtcttcacatccaaatatttttggtagcatgtttttccaaaaatctccttgtaagattaaatttaaaatttgagcctcagtattcaatatggtctagcacaaacatcctgagtatctcactttacacttaaatttattagactaagaaactgggtccttaaatgttagctgctggctttattattaactagcagtgtggcggtgaaaaagtcatcacaacctctccaggactctattttccagtttattgcccaaggcacttgtgaaaaaatcaagatagtgtacatagaaaaactttatagaaaatggagaacaatggacagaggagttattattagtaataataatggttggtaagttggatgaggttgctatttaaattcactatatgcttaaattttgtaaatgatcattttctagtgtgaacacagcattcttaaaattgtttcctttgaacttacatgttgttttctaagaaggttatgatgttttaaagttatcaagtgtaaatgaaaagagccaatgcatatatttaatattgtttttacttaaagcagtgtatataattagtgtctactccctaacgagtagggtgtaaaaaatgaggtacagatattaatttgttctgcttgctatactacattatatattcgtatgcatttttaaaacatgctttagctcaatatataccacatttgcaaaactcaagtgtcatcagcatcaaatcatttgaattattttttactaacattattttctctttaatggcaagaatcgcggctgtttaaagcacccagaaagtaactcaggccaaccatgatggcttgaaaatgtgactaatttattagtcatgcagtgataaactatatagtgaacagggagaagacaaaatgttttccaaaagaaatatccatgtaattttcaccacctgagttctccactgaagcaaggttaagaagttagcataatgttcttcctgaactgtgggccctgtgccaccaggctttcagaagttgagcagaaaagcagctcagcttttgtcttcccactgtcattaaaagcatctctgcttctctttcccttacctgtatccatgggagtctcaccacatcaaggaacattacctgtcattgtgatgcatttaagatgcaggtgtctgaatttttctttttccacttttttatttcatgcagtgtagtaatttaggcttcctatggagaggacatcttataaatgaaataatgtctcagatctgcatatacatgtgtctgtattagtgtttaatggttttgttttgaatcaggggtatagtggctattaatagagccagagaatatggcaaaaatccaactttctacacatttatgtttaatatgcaaaaccaattgttttccactccgttctttcctgctttctcctcctgtgtcgtttccatcctcataatggtgttaagaattggtataattttgttaactagaggctatgcaaattaatagagaaggtttattttgatggtctagataatgtgaaggagaatcactttctcactgtaaactaatctgtaatgacagacactcaatgtcaattgtgtcactgacagctttttatgccagctttagcaacctttgtccttctggatgttttctagtcatgaacatgatattcagtaatgaacacctttttggtagaagttgaatggaggtgatggctggtattggatgtaagccatattccttttccagaaacttaccgtactcaggaccaatacatattgactctgctctggtatgtcttcagtaatagaacagtgcttacaacgatggcatacttatacaaattaatgagtcagtagagaattaaagacacagaggaaaagaacttttccctgttatttactcaatgaagtataatttggaatgttgcgattatgccttaggtgcattcttagtccgatgaaaaaagtcaatgaggcaagttttacaagtattcataaactgtctactatgtgctaggttctttgctaggtgctctgccaggtgcaaagcaataattttgacatttcaaatgttatccttatgtgctttagacttaagtgcaatacaaattcagagaagagaaatttagtgtagcctgtattatttgttgatggctttgtagagcagttgagacactggatcttgaggaagatctacaatctggagagattaagaagagtagtgaaaatattccacttgggcagaatgacataatgaatgcctcagactttatttgataggcaagagtaaattgagaattttaagcaggtatgttccatggtcaaatagtattctgagagggattgaaagtggctggaggagggtgagggtttatcatttagaagggtattgcagttagctatatttatcaatcacttaaacaaatggtcagttcaggctttgtgtacatacatggctgaaatcagtcaagtaactagttgttttgaaattagctgacttgaaactgttgtgaaaacaaccagtttgattgaattcacttgtttctctccagatcagctcattattacataagcactatgtgttagttacactcagaaaaaaaatcacttaagcttgttgtttcatggcttataggcaaacaagcttgtagattacctaaaaatttggcttttcagttggaagtttcagtgttgtgtcgatacagccttttaagagttccatagatattggcaggcagtactaagatatgttagaattagttgttaggaaacagacttaagttatcaagagtagcaaaataagtccttatggaaagaagtgacaagacacacatagtatattttattaaatattttcagtggtttataattaatgtataaattaaaaattatattaatagaatgaagaaaggatgagaaggaaaaagtgacaaaaacactttttatatgtcattttaaaaataatccatattggaaaacatgactattgttaggaaacaggcttctctgaagagaaacagtgtgtttgttaaaaccatattccgaagagttagtatcaggctgaacattaagcagagttcatggatatttgttaaacatttattttctcggatctgaatgtcatgtcaaacttactttacctgaaggaacatgaactgctccatccttaaaaataccctggggcatctttatttttgttcctaatagccaacctaaatacaatagttatactgatttgtcttgattatttactattgatgcattctagataatcattatgatgtcattggcaatgccaagtaagttagctggtcatgacagcctgttgcaagagtggctcaccagctaatcacactgatcctaggatgagtggggcaatatgaggcaagaaaagccctttgagaaaagaaccacttctctgtggcagttcttgtccaacaaacacacactgctactattgagttctgtccagcttccagataatagctatatccattatatagcatccagagaggctagaggcagtaataccatttaagaagctgttggcacagcccaggagaaagttaatgttagcctggataaagtggtggcagcgggggcagcattggtaactctgggaagctggaatactgagagtgagaagagagagggtcagaatgactccaaggcttcaaccttgggtgactgagagtgtgggtgctattaaatgaaattgggcattcaggaagtagagtaggtttgtgatggggaaagatgttctattctggacatgtcgtctttgcagtgttcaagggggcaactgttggggttgtgagatttgggtttagaaaagagattcaagctgcagatgtagatatgggagtcatcttatcttcaaaatttagatgttaattgaagctgtggcaacagatacaattgcccatggagggaatatagagagccagcaaaacaaaacaatataaaatggattgaacaaaagacttgaggtgctggtggaggaagagtagccaatgaaaatgttagagaaatggcagaaagaagaatgagaatcaggacaatttaatgtttcagaatctaaaggaacagagagaatcaagagatgtggaggtggtcagcaccatcagatattgcagaaaagctgaataggctgaaaattgaaaaaaagcacctggatttggcacattggtgaacttcatttaaagagaaatttcagtgtagtagaaagagcacatatcatattgcagtgagtgagttactgaggaagtagaagagatacattctgtgtcacacatcatcagtgatagaagctatagtgataaagtaaaaagaaatgggaaaattgtcttagctttatggattttaattctgagagtgctcaaatgcttcattaggtggcatccccattccatatgcttatccaccatgaatccagtctaactcttccatctacagtatctagagtagtttgcccctcataatattaacatagctgaagcagcttcaggcatgacaacctcatacaacaatgcagaaaggggcagaaaaaaaacctagttgattcttgttactttttaagtgctaagaaatctttctcacctctttaccgcaaggagccttcctctcatatctcattggacagaattaggtcacatcactcttccttagccaatcactggcaaaagaacacgtaattaccataatccacctatactaatcaagattaacactctgtgattgagtcaggatctggagatgcagctttagctgggacctgggtctgggtctgggtctggaactagactttctttattcaaattagctttattgaaatacaattcacataaaataaaactcacccatttaaagtataaaattcaatggctttttatctattcacagagttgtgcatccatcaccaaagtcaaatttagaacagttttattgcccctaaaggaaatcccatatccattaaacagtcactctccattttcccttccccaatccctggcaaacactagtgtactttttgtctctatggattttcccagtctggatatttcatataaatggaatcatacaatatgtgggttttgatgattggattctttcattaagcataatgttttcaaggttcatccacattgtagcaggtatcaacacttcattccttttatggctgagcagtcagccctctatgtgttctgcatttgtggattcaaccaactgtggattgataatattagaaaaaaaacagtaaaaatacaacaataaaaataatttgaattaaaaactaatacagtataaaactatttctataacgtttacattatattaggtattataagtaatctagagatgatttaaagtgtaccagaggatgtgtgtaggatacatgcaaatactatgtcattttagataagtgacttgagaatgctcagattttggtgtttgaagcagtcctggaaccaaccctgaggatatcaagggataaccatatataatattccattgtatggatacagatattttgtttgcctatttattagttgttgggcatttgggttttgttttttttttttttttttttttactttttggccattgtcgaaaggccaaagcaatattcattgctatgaatatttatgtacaagtatgtgtataaacatgttttcagttttttggggtatatacctaggaacagaattgctgggtcatcagttagctctatgattaacattttgtggaactgacaaactgttttccacagtgattgaacaattttgcattcccatcaacaatttaagagtgtcccatcccaatttctctacatcctctataacagttgttatcttttttaatagctattatagtgagtgtgaagtagtatgttataatggatttgtagtctttcttgaagcatatagataagtggaggagcgaggatatctgaacaaatctgggatgattttaagacaatgccatagaactgttgtgtggcgtccatgagcatttgtgggctattgtacccaatttcttttctttctctctctctctctctgtttttttttttttttttttttttttgagacggggtcttgctctgtcgcccaggctagagtgcagtggcacaatcttggctcactgcaacctccgcctaccgggttcaagcaattctcctacctcaacaattctcctgcctcagcctctcaagtagctcggattacaggcatgcgctaccacgcccagctaattttttttttttttttcagtagagatggggtttcaccatgttggtcaggctggtctcaaactcctgacctcaagtgatccacctgcctcagcctcccaaagtactgggattacaggcatgagccaccatgcctagctttctttttctttttcttttttcttttttttttttttcattgatggtggagtctcaccctgtcccccaagttagagtgcagtagtggtgatctcagctcactacaatctctgcctcccaggttcaagcaattctcctgcctcagcctcccgagtagctgggattacaagcgcctgccaccacgcctggctaagttttggatttttagtagagacagggtttcacaatattgaccaggctagtcttgaactcctgacctcaagtgatctgccggcctccacctcccaaagcgctaggattacaggcgtgagccaccatgccctgcctccaatttcttttttgactgaactgtttcctactggttagttgtgcctcctttgggtctcaaaatctcacctcttcatgtgctcatgcactgctctgtctttaatctcctatgtagcctggatctctagaagctgactctaacattctttatttaaagaaagaagtgagaattaactattatagaccaataacagagtctggtcacaaataaatacaaaaaatgttcttatttaacttaatttggtaacttttttggatttacttcaactttacatttgatacattatttgaattatcaaaattttcaggtactgactcaggaaagattcagcataataggcaagcatatttggatctaataataaattatataattgaaatatggtataaaaatataactcttaaaattcatctgggctgatctattggttactgtgatagatgatatagatgttacaatagctgattggtgttataacaccagttcttagaggaccatatatttgtcaggctcatttacctcaaaagcaggagttaggtttggtgaagcatggcaaagagtaaatttttagaaacataatcatgggcataagaagtcttactcaggagatgggtgtgcgggtcctgtaaatccttaggccaacactaaattcagtctgagcgttccaagggagctagcatgaggatacgttaaggggcttaaaaccaaaagtgagagtctacagcttttttcttgtgattagcaatcatacacccatagagctgctgtgtggacctccatgaccatttgtgggctatagtacccaatttcttttttgactggactgtttactactggttagttgtacctcttttgtgtctcagaatctcacctcttcatgtgctgctagactgtttctgcctttactctgctatacagcttggatctctggaagctgactctaaccttctttaagtaagcacttgtttttttttttgttatcagacactgctatttgcctagccaaccaccatttcctctttcttcattgtcaatattatgttggatgtttttcaggtatcttaaaattctagattcataaacatattttattttataaatgaaaaggaacttagaagccatttagtcagtgtcttaaaactgtgggtgggcaatttgcctactaataccacatgggtccttgctctctcttgggaatctattaaatcagcatctccgggagtggaacccaaacactggtattttgcaggctcccaagagtagttaaaatgtgcatctagttagtactagtataccatcccaaaaattactttgagggacatgaatgttaatgttataaaaggctatgctttggtacaaccctaaatttttctgattgatatcatgtggataaccatgaccctgtatctctgctccagaatgctccttgatacttctataaagaccaccttgactaggaaggaccatgattgactcagtttgacattttgctttttttttttttttttttttttgagatggattcttgctctgtcaccaggctggactgcagtggcatgatcttggctcactgcaacctccacctcccaggttcaagggattctcctgccccagcctcccgagtagctgggactacaggcatgcaccaccatgcccagctaatttttttatttttagtagagacggggtttcaccatgttggccaggatggtctccatctcttgacctcgtgatctgcccacctcggcctcccaaagttctgggattacaggcatgcagcactacacctggccatgtgatttaaatatatatatatttgtttattacctatgtcaggatgtaggtaagaacatatccaaaaaatattccttctccgccataaatttgatgtctctgttttcaggttagggttatgtgtattagaaagttatcctcatattagtatgatattttctatatacatttggcttgaaagacaggttttaggaatactgaagaagattgaatagtcctttttaactttaacagctagtgagtttgttcaaataatgacacttttcccctgacttagagataattgctcgggtatgtgtttaagtgaagtgttttgggaaacatacttagttatatccatgttttcttccatgaattgtactctaattaagctctgaataaaataggaatgcttttttataccttggttttgaatccattcactttaggaatgcattctaaacatgaccatcagtgctgaattcataatgcaaagttacttggaaattgaggcatgctagttcgttcccaccacatcgacttattgggagatcggccattcttggaaattgctcccagagaaaccaatcatcatcaagttttattacacatgcatagtgtatagtgctccaggatccataacagtaacaaaatatggtatcagtcgatggatacaaaagcatatgtaatgtgtaaatgtctatctgcatgcagcattgtactgagcacttaggtagtaactcggtgctgacacttgtattttcaagctatattgcatattggggtgattgacacatcaatctagttaaacagaagcagaagcagaaaactgtcccagagcttcttacaggaggcaaacaacttatgtctacatgtatgactatggaatcatcttttacgtaattaagtaaaaatgatctgctagaccagttattttcaactctggctgcatattaagatcagctagggagagttttaaaaaataaagacaaccagttctttctctcacagattctggtgcaattggtcagaatggggcccaggcatcagcatttttaaggcccccaggtgattctaatgtgcaaccaaagttgagaatcactgaacctgactatgcatcatgaggataggagccatcatttgtcttgtttactgctacactcttttgtccaggccagtgcctggcacataatacttcaataaatatttgtttcatgcaaagttaccatctctagaatcggtagagagctgaacatttagactcagttatccaggcattcaaaaaccaacatttttgtggaaagcagtttggcatttcctcaaagaacttaaaatagaactaccattcaatccagcgaactcatgattgggtatatacctaaaggaatataaatcgttctaccataaggacacatgcatgcatatgttcattgcagcactattcacaatagtaaagacatagaatcaacctagatgtccatccatgatggactggataaagaaaatgtagtatatatacactattgaatactgcacagccataaaaaaagaatgaaagcatgtcctttgcagcagtatggatacagatgaaggccattatcctaagcaaactaatgcaggaacagaaaacccaataccacatgttctcacttataagttaaagctaaacgctgaatacacatggacacagaggagaacagcagacaccaatgtctactttgggtggagggtgggaagagtgtgaggactgaaaaactacctattgggtactatgcttattaccggggtaacaaaataatctgtacagcaaacccccattacacacaatttactcatataacaaacctacacaggtacccctgaacccaaaataaaagctttttaaaaactgctaaatgtttatagcagttagaggcctgcggatggttacaaaagagatgatctcacaaaagccctcaccaggaggtcttctcaactagtggtagattatgcctgcttcttgcctaaaataccaaactgtcaaaacaaaaaaatacaggggccctgacctcaaggtgtttgtaacctacataaaactactaatttcctacttttttgtggtctccttcttgctcctactgagaggtgacagcgtgctggcagtcctcacagccctcgctcgctctcggcgcctcccttgcctgggctcccactttggcggcacctgaggagcccttcagcccgccgctgcactgtgggggccccttcctgggctggccgaggccagagccggctccctcagcttgcggggaggtttggagggagaggcatgggcgggaacccgggctgccagcagtgcttgcgggccagaacgagttccgggtgggtgtgggctcagctgccccacactcggagtggccggccgggcaatgaagggcttagcacctgggccagtggctgcggagggtgtgctgggtcccccacagtgccggcccaccggtgctgcgctcgatttctcgccaggccttagctgccttccagcggggcagggctcgggacctgcagcccgccatgcctgagcctccctccccccgcccgcctccgtgggctcctgtgcagcccgagtctccccgacgagcgccaccccctgctccacggagcccagtcccatctaccacccaagggctgaggagtgtgggcgcacggcacgggactggcaggcagctccacctgcagccccagtacgagatccactgggtgaagccagctgggctcctgagtctagtggggacttggagaacctttatgtctagctcagggattgtaaatacaccagtaggcactccgtatctagctcaaggtttgtaaacacaccaatcagcaccctgtgtctagctcagggtttgtgaatgcaccaatcgacattctgtatctagctactctggtggggccttggagaacctttgtgtggacactgtgtatctagctaatctggtggggacgtggacaacctttgtgtctagctcagggatttatttaaacgcaccaatcagcgccctgtcaaaacagaccactgggctctaccaatcagcaggatgtgggtggggccaggtaagagaataaaagcaggctgcccgagccagcagtggcaacccgcttgggtccccttccacgctgtgggagctttgttctttctcgctttgcaataaatcttgctgctgctcactctttgggtccacactgcctttatgagctgtaacactcactgcgaaggtctgcagcttcactcctgaagccagcgagaccacgaacgcaccgggaggaacgaacaactccagaaacgccgccttaagagctgtaacactcaccgcgaaagtctgcagcttcactcctgagccagcgagaccacgaacccacccagaaggaagaaactccgaacacatccgaacatcagaagaaacaaactctggacacgccgcctttaagaactgtaacactcaccgcgagggtccgtggcttcattcttgaagtcagtgagaccaagaacccaccaattccggacacactacgtccattaagaaatgtggacaaacagtactctaggtgagtctgctttttctttgaataataatattaaggggaggaaggtagatatttgttgtgtgaacagagcaacagacctctgtggaattttcaaagtagttttcaagtctgttaacacggtaaggtgtttgggttatactcttgctgtaacttccaactttgaaatctagcttactcttaattgcgtctcagaaactttgccaaacagaaaactttctaactagttttcatctcttactctttctcatgacttcgatgacttcagaatcttatcccaaaccccagggttatgactccaatttaaatatgtaaattaaaaaaatgtaatgccagtgccctttctttttagtgtatattggctccaaatgctggcatagctgggatttgataattactttgtcctatagtaaatctagttgggtagtgaatcaggtaacatttaactaattgattgtattttctttttattaattccatgtttgcaattgagttatgtatgaagcagtaaaaacatcctgctgttctttttgtaaatgatgttatattttatcacacagtgtcttaagaatactaatgcttaaaaagatgacttgaggattaaaatgcagctttagcttatgggagaaataccactcaacaatagtagatacaacatacatgtagtgaaaatgacaatcaaactggtctattaagtgcagagacagatgtcctatgtaagagatttctgtgtcattgctgggaaacgtgtgtgtgcattattcatctctgctcaggctctacattcaaatcctttccaagtattcccttttgaagtactttcatgctgaattgctgtctgtgagtttttgccttacgtttaacacccaatttgtttcctctcagaatcacagtagcaaagtaggggagaaactaagggtcaaagaatagcttaatctgaaaatcccagttttatgcagttggtataagaggactccagtaaggaagtactttatgaaagtgaaagctctacaaatgttagatgggattatttttattcaactatgtttggcattaaaataaccttagttgtgctgattattaactttctgtaattacccatcaagaaaaggaaaagaaaaagaaataactttgaattctgtttcagcagtattgcctgaggaatttaagctagtcaggtttttgtttttgtttttgttttaatccagatgattatttacgtttacatgtgtaagaggaaaagacccttttcttaaaggacttaattgctgtaaaaaggcctataattaatgcagtaagtgattttttaaaaaaatctccattttacaggtaaaagtaagtgattttggaaattgcttttgaatagaattcccctcccccaaagtcatatgtcttaaggacattctgatggttaaaactcaaggagagaattctgctggttttaccttttctacattgaaagagaacacttgttggcagtccgtaagcactagatttccttcatttagctctttcttgggggaaacaaagtttttacctcaagcttctcttgagttcctgacagattccattctccttgaaacaagcggtaactgaatattactaagacagttcctccagtgagaaaactgcagttggggaactctagccccataattgctttttcatttgggactcagcttgcttacaaagaaattggatgtttgggatttaaagacacacctccattctttgtaccatcactgatttaattgtcctgtcttcctttctttcctcccttctctcaagcaactctttcagcaagtgtgatttgaattaggcttgccatattgccctcttcaataacatcaaccagcctcttgaccatttaatccattttgaattctgaagatacttttgtgtggcaataaacttggttgtcacaagcttccttcttcccagtgtcatagtttgcagaaactatttaggaaaatctggttccttatgttcctagaactgtatggctatagctttccccttagaaatttccctatggaaggatggcttctattacacaggaatgctttctctgaatactgtgaccagagaatctaagtgcctgtgttgattttgaccaaattaacaaaatttctataattcatatcttttcgttttatgacaattaagtaatatttcatatgtgtcacttttattattttttcttttcaaccacacctgttttggtcaagtcatctcttactttcttaaactcccatacattcacatacatacacatttctttacacattcacactattttttttttttttttaaaaatacaaagtcttgctttgtcacccaggctggagttcagtggtgcaatctcactgcaacctccacctcccgggttcaacatattcttgtgcctcagcctcccgagtagctgggattacaggtgtgcaccaccatgcctggctaatttttgtgttttagtagagatgggattttgccatgttggccaggctggtctcaaactcctggctgtaagagatccaccagcttcagcctcccagagtactgggattacaggcatgagccaccgtgctcaggcctcaagatgatattctttatgaattttttccctctattttagctaaagttattatgaagtatcgatatattcactttaggccaaggtttccccacatagacactattgacatttggggctggataattctttgttgtgagggtctgtcctgtgcattgtaggatatttagcagcattcactacatgccagtcctaccccctgcccaagttgtgacaatcaaaaatgtctccagttttgacagatgtccccaaagttggggttggagagcaaaattgtccccagttgagatctactggcttagaatatctaggacctggcctttcactgaaaagatacaatcatttttcaatgtaaaccatatacacaattttcaattaatgcttgtaatactgtttgtatgtactatactcataaccttccatatacttcctattatttgaagagttacaaatagtctcacctattttccatgattgtgacatgattatatccaaataatccgtatgtctttacccaagccccttttacaagcattttctctcacaaagcaataatctataatataccacaaacagttcatctgtgtcattttttccgctggtctccgatctgttatgttatgctgacttgccattatttttaaagcagtgatgctaaactattttggataaatacctcaattgctttgtaactttcttggaaacattaaagatattttattttaatatttgggagtatttcttttctactaaggacttttagccagcattcctttgtaagatatcatgttctgatgatttatttgttaagtttaccctttcaatataaccgctgctataagctcgggatgcattatacattttcaagatctgtaggcccactggaattttgatttttttcccctgacattcacaggaatattatacagacagattttctatttaaagataactttgactttgtataaacctcactgtgccatttaagtgataaatattggtgcatgaactggtttgactttctgctgagaactgctaaaagccttttaatagaaaacaatagggaatgtcaaacattgaatcacgatctcactgaagcaatttttcttagaaagactttcatcacacagaagttttatccttgctcaaattttgccagaaattatgtctggttaaaatctattgtgatgccttgtgcagcttgtttacccaatcttttatgaataaagggcagctttttaatatgttaccagctttgctcttctctttcttttttaaaataattttcatacttaaatactaactagctttgaacttaatttttgtctaaagatatatttagggacaaaacagaagactgtaattttattttaggttaggtatcactaagagaggtggttaatggccacatgtatgtttaatggtatgtgactggttgctttgggagcaaataaactagaattcccccaaatgagccactcattttactttgtcttgtcaccagtttgtgccttctaacccaggccagctgtctcacaacagaggccacgtgaaaggaatgcaggctcggcagagtttagtcatcactgtaaaaaattgcttgaataatataaactactaggtttatttatcttagcattttcaattacaatgtgagctcagtgagttttgactaagccctacctttttcaatatattaggtctatttagaacagctaagaaggggaaatcaaaataaaaatcaaacagtaactggcttcatgtaagcgtagtctgcatgtatgaaatgtgaaaagtcccatttcacagctaaccaccattttggacttgccattatcttcctttcttccttctttttttcttcattcttttttatttctttccttcctttcatttcttgatagcagtgtttagctggtggtgatcctcattaattctcttatccttcaataactcgtggagaaatcctaaaatcccttgttttgatgccagaagcatgtgttggttactgaaacaatagtctaattaggctccaaaattagaacgttgcctgtgttggaccctagaaggggtagatactaaaaaactaacagatacacattgtggttagattgtgtgttgtattccttcattgcacactgtcatcctaattcagtgccttacatatagaaggtacttaattttattttttcttttatcagggtattcttactgttgaagtgaaaaaatggtcctgtcttcctctacttttagttttttcaatgatcgcaatatccatctcttcccagataaggataggaaatgttttatgtagcattattgtacaataccttaaatatatacttaatttaataaaacttaaaatgcattagaatttatcctctattggatggaattattttccttaataatttaatatattagttaattcatttactacctaaaaattcattaagaacgaaatatttcctataccctgtgctgagcactagggatgcaaatggatgagatgccattactatcctcaggaaagaacaatctattggaagagaagaagacacaaataactgtggtctggtgaaacaagacctatagtatagatagatacaatgtgccatggcagatagaggaagttaattctgttaatggcgatacagggtaggctgtccagaaagaagatgacacttgagctggtcttaaaaaatggagaggagtttgccagttaaaaaagtagcagtgtatattgctggaggtgataacatccattccacactgcagacagagcataagctaaggcatggaaatatttgacttgttgatatgcatgtcatatgttccagtgtggctagagcatcagtggcattgggacacttaaagtatatgatactagaaagatagacagaaccttgaatgcctattaatcaatttggattttatcctgacagcaaaggagaaccactgaagtgttttaagcaggagtttgacagtatctggtttctaatttagagagaaaattctgttagcagtattgaggatgggttggagggagaagatgtgggatattaaggaaccagttaggagtttactataattatttaggtgatggacaatgagtgcctggattaggacatgggcattgcaaatggaaatgatgacatatttcttagttatgttagacagaactttagtaaccacttgtatatggagaataaggagcaacagagaagaatgatcccaaggcttctagatccagccactacgaacaggaacacaggagaaggaggaacagctttggttaggaaaggtgatgttggaagtgtttgttgtaagattactgtaagaggttagacatttagaactatggaacttgagttcaagagagaattagagttagagacagacttgagggtcatcaccatatctgagatagttaaaagcatgaacctgagtgcaattgttcaatgaaagcatatagaataagaagagagcagagaagaaggaataactcggtgtaggggggatgggttttaagaagctggtagaaaaagagaagcagacaaagggatcaagtagttgcactacagatgtcataattggactacaggaaaaccagtgctgttgggtaactgatagaaaagaatgagcaggtatggaaggaatgagaagagagataaattaagaaagggagaaaaattgagagagaatagacttagattgaatgctgcgggaaaagagagagcaaaggagattgaaaaggagaaaggagtatgtatatacatatatacaaagagagagaatagtgagagggaatataactgatacagcaagttttcagatgaggcattacgggctagtagcgcagactgggggtaaaaaacacaggtgagaaagattcttgaaaaattaagaggacatttcttcctctgatgcgaagaaaaaggagtaagaataaatgaaaatagattttgaaggtatagttaagggaagttgagagttcaaacatgacgacttgatttctctatgaataagagaaaaagtcattggcggccatgacagtgagttggcctaagtgaagtaaggctgatactttatcagcaccagtgatagttttttgagaaccaacttgtgtaaaaaacatttataaatctgcggtgtaaccaatcagcaagataatgagggttttctcttgctcttggctgcttgtgagcagcaggaagagaaaaataaaatgaagcagggatggatgcaggattatgaattggcaggtcaggtgtggtaccaggtaagccgcgtagggacctgtgatcactagtgagggttaggtaggcatataagggaagttaggaagacactgatggactagcaactcagagacaagggatgtggttggaggtcttattgaggtttagtgggagtgaagaagtatattttgaagtctaattataaggttagagtcttgcagatttaagtagagagtctattatggcttaactaatttttataactaaaaagtaatgttgagtaaaacatgaaaagaatttttaaactcctgtgaagtgtgtaccagtgattagagctgcgacagcttataggaataagatcagaaaaactgaagctggaaatgaaatgctctgtgtgtctgtgtgtgtgtgtacaatatatccacacatatatactatagtatggtatatactatacttatgtagatatataagatatataaaatacacacatgtatacacatatgcatacatgtgtctgtgtgtatgtatataagatatgtatacacacatatatgtgatatatatacacacatatatgtgatatatatacacacatatgtgtgtatatataaataagatatatataaattagatatatatacacacacgtgtgtgtataaaaataagatatatatacacacacagacacatgtatgcatgtgtgtatatttgtatgtgtgtgtatatttcatatgtgtcttatacattttttctttcaactattttgagaaaatacaaacgtggaaaaaaatgaatctctgttaagtaaaaagccaaagattggacctgagaggtgataatggaaatttttagggactatggtcatattcttggtaggtgggctcagaattcaagattttaatatattgaagaaatggccagaaattaaccaaattttattacagcatgttttggggcattggggaggcaaaaacaaaccgtgagtaagggaagtcttgcatgttaatcctaaaccctttaatttttcttatacctcactagatatgcattctagtaacttagaatttaagtaggtcttccttattaataggagaaactgcaaatttactctacccttcactttatgtacccttaattctctctatctcagaaacatcttcatgaattgaactttatacctctattgacacacacaagtggttctaagcccagtgcctagaatatttcctagcacttaattagaaatgtagataaatacctaaataacaataaaacataatacatgctataatagagaaataaaaggaggaaatggtggtgcctgaaggaggaaatgaccaaattgtatataggtgtgttagtgacacatgtctttaatcccatggctcttaacgttgaccctcaaatccttaaaccccctccccagagtctattttccaccctggattctcccttccttatctccttttgccctcaccaaatttttccaccattttgcccaatttcacaataatctggtaaagcaactggtaccaatgagataacatattagtgtattgataagagccttctgaagggattgtttcaacccaaaggaatgacaccataaaatctcagatattatggcaaaatcatggggaacattatttactttgggtagacaggttgtctaatgactctaaagtcttatcacattggtgtttatcctacttacatgtaagactgaccttgtatttgtataaaatttatatatgttgcctagtaaaattctgttgatcatttgtgtcaattaaaaggtctctgggtataaaagttgtggtctgaagaggtgcaaagatttagttagttttactatcacggtttcctgaatcattatggcttctatgattaagaaagttttaaagcaacttgtaaagatttaactttgtcctatgccggtaaatccaaccttgatcaaactaactcaagttcccagctccaagagggcatttgttctcactgtgttttctgctcgatttcccccagctgaagtgaaatggatgaagaattttaatttgtcttttttgcattcaaatataaaaaagtcattggatgttagctgaaaacttatgaagtgacagtcttgttaataaagacaaatgagatggcttgttttattaatattaatgttgcacataatgtagctttgctaaataaatatatggttacattttgcaaactttgcaaattaagaatttatagcaattgtagattttaaggccaagttacaaattttcaggtgcattttaattgttggcaaatattttaagattggagaatcacttacatttatttgaaatatttgtgaagaaacttagcttacagccttgatgatttccagtatttgtagtgatgtcctaattatcatactacttatagcaattgagaactatggtaattgagaaggagaatcttccacaatctaatacaagtcaatcccactaatatgaactccataggggagccacatgttctggctgctgtgaaatgcttgcagtcccaaaaaagaaatcaggcccagattttctgtgggagatggggattaaattaatagttaatggagaaaataaaaaaattggaagggggaggacttggacatggcttcacttcactcattcattcactcattaaatatttatgagcagccggacaaggtggctcacgcctgtaatcctagcactttgggaggctgaggtgggcagataacctgaggtcaggagtttgagatcagcctggccaacatagtgaaaccccgtctctactaaaaaaaaatacaaaaaattaactgggcgtggtgggggaggggatgcctgtaatcccagctacttgggaggctgaggcaggagaatcgcttgaacccgggaggcggaggctgcagtgagccaagatcgtgccactgcactccagcctgggcgacagtgtgagactgtctcaaaaaaaaaaaaaaaattatgagcacctgccaggtgccacatcctgtgctgggttctgcaaataagacagatgaagtccttgtcctcatggttgttcgttacctccagatgtggatgctcctatgctcctgtggtattctgttagttgttttggaaacttggttggttcattatggtcaaagttccaaattagttaagatgattaagatgttgaggtgcagagaggggaggacagagggaaggagagttgtagctgaacaaaagagccatgaaatgcttagctgttctctctttgccatactccctcatcactgcctaattttcacaatgggttagcaaatgtgaagtgttctgtaggcagacatgactccattcaaagcttttcataatcattttggaaagtggcaggaattagaagcccagcattggcagcacaggaggtaagggtgatatttattatagaccatttttttgctttgtagtttatggagtaagctaagattacaactataattatattattcaatgtttaaattttatatattatcagaacaaatattaatgtgtaagagaggcatacaatgtgaatattgagccatctctttggattcattgaaaggttggttttcccaacttatatttataaatgacttaggaccactgataatgctaatgaatttagctaaaaagtatctccagaatgatactcagacattttgtacatttagatttattctacaattcagtggggaacaaaaccattcaaaaccattttattttgaataatttagttacttcttgttttcctaatgaaagaatttgctttttgattcaaaattattctggatcaatgagacatgagggacatctatgaaaaaataaaaatctataaattatccagatttttaaaatccatatgtttaatttcatagtctagaaaaaaataacatctagatttgactattttccctaatacctggaatgtatattttagataacataaaggtagatgaagtaaatgctatgttggtctcttttcagggaaatcttgtgactttttcaacattgtatcacaatgtcggaaaaattcatgttttataatctagaattttatttgccttgctttatgtagagaatagttactttccttttgtcagaatttctaatttctaatatctcttatgctagctgctattttggtgataggtgcttttaaagaaagcttcaaatgattgtactacttttacctagtagctaacattagtttccatgacagaaggtgtgtaaactattgtcagtcttgacaacatagaaacaagatcagctttactcaagaaagttttcatttaggttaataatattagggtaaaatcccaactgagtctatatcaggaaatcttttatgatctgatattataacacattcaagaataacaaattttcctttaaataaaattagagggagttgctttgaggctgaataaaaaatatattggaaaactgtgtatagtggagatatatgttcctgctctgttgggaacccatttatctctgactctaagactaatcatgttatgaatagacgtacacactctgggcaacttgaaaaacaatcagtttgttcagctccagaaggaccctctgagatagatttcttgcctgaaaaactcttgatttgactccacctttttatgagattatcaaatatttttacatgttttgcttttgcatgtgtatgcatcccatgatgatggttcatacttgaattgtgtttattgttcatattcttttatctcattttttcttcttggtacaccatgtcaagtattactgattatgaacagatgctgtcttgatgggccgatttaggggcctacatcttatttccaaagggcttttgcatactctcactgctatttcctttggataagaattttgggactatgtatagacagcatacatgacactgtgatacttaagatcagttatattttcagatggcccatcttatccttgttagaatgacctgaagctttgtggttttagctgtaccaggatgagatgcctagagatgtagaagggtcagacttcagtagaattgcagtccaggcttgcctgtccgtgttaatggaaagatgtcatgttgtatagcagtggggtttttcagcttttttttttcaagaagaaaataatgtttttaagtaaaattttctgtagaaccccaatatctacaacaattaagaatatggagttgcccaaagcagagaaagagctgagacccactctctcatctgctttgccttctgctaggcctccttgtcaccccactccgtgacccttcaagaacctctgtggagtactaaagctctgaggaatgaaattgataaccattgtggtacgaataatttttcttttttaaaatcatcgatcattgactgaaattttttaaaaactgcatttcaaaattggggtgtcagctatctagggaaatcatgtcagttaaaataaaagcagtcccactatccaaactggaatgtcgaagaaacaaaaaccttctcatctttaccaccctaacaaaaaattaagcgtaaaaagcaataaaagttcaagtaatttgaaagccaagttgcatagcccagcctcttatttgctgtgtggatagaaagtgaactaacatttgatgaatatctactatctgaaaaaccttctgtcatgtgcattatatagtattctctaatttaaatctcacaacaatcctgggaggtggaaattattcctattttacaaataataaaaatgtggctggtggagataaagaaacttacctgagatcacacagctaggaagtggagggtctgggttctgaaccctaatctggctggctcaaatgctcataccctttctccagtcctgtgctatatttccagaaatatagtgaagggaagcaaggatattatgaactataaacacaagattgtcctgaaaaatatgtatagagatgcacttgaccacaaacacagtgtttttcatttgctgtttatataccactatatctgtgccccttccttttatatgcaatatatttgatatattcttccttcctcattcctcttctgttatgcttctctcctttcctctttcccttctctctctacttccaccttcactgttgcacagtcttaagagatatgggtcctcctctcatctagacacggtatttgttggttttaagaaatgaaaacccagttaagatagtaaagtgagaagatccttaaaagaatatagaggtacctcacagaatgcaggggcaagatgtaactgccatgccaggaagtgaggtggcttttctacctctctgtgagtgcatagtttttcttatgtctgcttctctcaaatggcttctttctgcacatctgctcttactccctctcacacctctgctcctcttaattggctccctctgcttaggaatctttagcattgctcagtatggatggcctggccctaactctgcatgggctttcagatccagtgcctggaactttcttccatatctctaagtttaatgtcttgtgggcataaggttggctcagctcagcttataaatacatcctcttttgcgttaggtgttcaaccctgatccaatcagctataatggagtgacaggtcacaggttcgaatatggtcccttcagttgagattataggtagggcctaaacccaaagatatgtctagtatactttcgtcaatactggactttacttccagatatactctccttcctttaccctaattactctagagaagaagggaaggagggagccctgtgggtagcaggactttctcctacaaaggaagttagattgttccattcagggcttgtggtggttgatgtgtttagctcaaccagatttggacatcccagagtgtggcagaaggctcagaaacctttgtaggaaatgaagtagaaaaaatattacttaggtaattacttttgcaacaacttttaaaatgtacttgataaataatattttacatatttataggatacatgtgatatattgttacatgcatacaatgtgtaatacacaagtcagggtacttaggatatccataacctcaagcatttatcatttctatgtgttaggaacacttcaagacttctctcctagctattttgaaatatataatacattgttgttagctagctatagtcatcctactccgccatcaaacattagaaattattccttctgtctaactgtatgtttgtacctattaagcaacctcttttcatccactcatccatccacccacacacccttcccagcctctggtagctatcattcttttctgtacctccatgagatcaacttttttagctcccacatatgagtgagaacatgtgaaatttgtctttttgtgtctggcttatctcacttaacataatgacctccagttccatccatgtttctgcaaatgacattttattcattttttatggctgaatagtatttcattaaaattttggattagtatgaacaacatgaaaagcctttacgatgtggcacagtcgcgttagacatggatcaaaaacgtaggtgtagttcaccttgcctgaaattgtgttacatgtacaagtggtagaaaccaggtttctataaataagatgtgctggatgctttgtttctaataaactcatccatgctcaagagagaagtatctatgatgctgttgtactttaatgcccagtaatatattacgaaagtattttaaaaatcacttcaaagatcatcatcaaaggatagtgcagtctttgattactccttgaatactctctctctacttctctctctctcattctctgtctctctctctctctctctctctctctctctccgtgtgtgtgtgtgtgtgtgtgtgtgtgtgtgtgttgagggcagctaattgcagtgtgaacctgaagtaatgcttttattataggctaaagaagtgatatcaaactttgtctctaggggttatgatttgagtagattataagggttatgatgtacaagaacttggttgaaattattctagtatgcattattccaggcttgatgtatcatgttgtgatatagcagctctcaattttgtaaacagcctaaaaaggtttctttgggactccctagccatctcttattctggacatttaactaagaaagtaaaaaagaagttcataatcaccaagttcccaaacttgtcaatgtatcattttcaggttgaagagtttttcatggaaatgctttgcttctagacaccaccccttgccttctgcacaatatcagcagatgtggtggtagcttcgggagggctaacccctctgtggttgctcaagtttttcaactttagagtcttcatatcttatgattcccctatacttcacggatgatgacttcttgcttcattggggccctccctgaccactctatctacagcaaacttcctcatccccccattctctcacttcatattctgttttgttgtccaaattttacttattacaatctgcaattattttatttaatcattttgtgttttattgaatgtatcccccatcagattgtaagctctgagcaggcaaggaccatatctatgttagtcaacattggtatccccagtgctttatacagtgccttacatataaaatgggctcaataagcattttagggattggtgaatgaagaaaacagtagtagaacactatcatccatgataacaaagcagccacagaagtcatttcactttggaaagtgaacctcttggcacaatggctgtgtctctcatgtgcacatggttagtataccagtcatccctggagaaagggatgggggattcgggcaaatcatgttatattagaagtccccacacctaccattcaaaatgaataattatcaatatttaatatacttaatagaaaaatgtccctattttaaatgtgcagactggtgatttttcatacaatgagcatacacatgtagccagcacctagatcaagaaacaatattcccaataccttggaagctcctctcatgcctgcttccagtcactgtttcttcaaggttaactattattctgtcttctaacagcatacattagttttgcccatttgtactttatataaatggaagtatacagtttctattctttcaacattatgtttgtgagatccatccatcaaccatattgtggcattccccacacttaatgtttttaaacaagtggaaatgaatcccaagacacaatgagagggcaacgtaatgaggaaaggaggctagttatatagagtgatgattggagatttatgtgctgaagtgagccatgttctattaaattcactgtgccttctttgcttcctctagccttgcttcccaaatcctaaacattcagcttacaaatatctgcccttgggaaaaatacttactaatccaccgaaaatccatctctgctactgcagaaaaaaaaaaaatcttttgagcccgtgctgtctccctgaggtgtgtcaatagtgccatttctttataccaggggcagcatttaattattgattctcaatgcatatgtcctggaggtgtttattaatctgagtttagggacattgttgtttccctctatgtgcatgaatttatgagaagacctataggggaggggtgatgaaaaaactgattaagtttctggactttacacagaaagggatacaaataggatactatgcatgatttaaaattggcaaggacaggcctccagcatgagggaatctctttgagttattaatcatgagttatatatttttgtgacagtgaaagggagctttaattaaacacaccttaataaccttcccttacaaaattcctttttaaaaataaatatggcatcaagtaatatatggaaggtgtagagtaactcttctagagttctatataatggagaagcaccccctgacaaagaaggttgccaagcacttgcacaaattactaaaaaaaggctggggaatcactggccatctgttcagcatggttctcatgcaagtgtgcctggagccatggggctagatggcatgatattagaagggaaagatcttttggttttcatttgatgattatcaggtttctttaagtctaaaaaatgccttaaaacttaagtaataaaagaaggtgttcttttggctcatgcagtgtgtcgatctctgtctctcccaagcatttttagactttatgccagagaccacctggaggcaaaagacaccatttatttaattccttccaatactagtaccacacattaaaaaaaaaaaaagtattgtgctgttgcttgcgtaaagagttattatttactgggcctcattttaaaatgtttttattgctttttaaagtggtcaaaatgacacttttaaaacccacaattttgtgtgacctgcatattgaaccagtccagacaccgcttgaaaggtctttgcaggccactatggctccatacacaataataatcaatatcacttagactacttattgggtacacactgtgtgccaagaactggtaggcactttatatacgttatctcatttaattttctcaatgatctggcaaggcaggcacaaccaccactccactaataaatgagggaaatgagtcttggcccagtcagataattagtcctcagccacattgctcatttgttcaagcactgaattatgaactcgggtctgtctgactccaatgcccacattccttccctacaccatactttcttaatactttgggaaccgtggtctacactcatttcttgatatctgtgggggattggttccaggaccccatggataccaaaatttgagtatgttcaagtcccttatacatttgcatataatggatgcacattctcctgtatgctttaaatcatccctagattacttataatacccaaatacagtgtaaataattgttatactgtattgttttttctgtttttttattgttctattgttaatttttaatttcaaatagtttcaatctgtggttggttgaatctgcagatatggaacccatggatgtggagagctgactatatttcaaataagactctgaaacaaacacaacttctgatttggatatctttctaggttcgtctggtttgttttctggtcacttttaacatagtagtaatcagtactaggtttgaaccttgcctttgccacttgccaactttgtgacctgcagcacgttacttaacctctctgaggctcaggttcctctttcatgaaatagttaaaataatagaactcacttaataaagatgttttaagaattaaaggagatgatgcaagtgaaagtatatatcaaaataatagcgagtgtgtagtagatgtgcaagactattaataacaaagatactaggactggtttttgaacttagagcaccttggcagtgtctcttctccttcccagtaattaactcagttgctctcttagaagccttttctgttccatcaggatcagaaaacgtttccttacacccagagtttaacaattgaatccaggctgtcattacaaaataaatcttgattctcatacttcaatttttagcagcctgtcttctcttccttaaggtctaaagaataaccataaaaataaaaacgtgattctgctgagacagcattagaaaaaaataataaatgaaaactaaccctaatcaaaacaaataacatatatccaagcatctcaaacctttaaaatgttgtaaaggtagaactcatgtctatttacctagccctatgattgtcatatgttctaaaccaaaaattaggacacatagtccaacaaagaattcattttcagatttgtattctgatttatagaataagatacatggaagcataacaattaagttgcatttagctatacattttctgagtcatctttattgagaagaatatgggacactataaagttgaactatcctaaagattagggacatgtgatactctacacttttcttttgaataaaagcatatcagtaatctttgaatatccttgaaaagtaccaagatagaaggttattaacattcattgcaatgttaataactttattccagaattttcttttgtttctgttgtataacttcacttgtagaacacccattaatgcaataccaagcttatagaaacacatgctttatgtaatttttagtgtcggtaaaagtgatattcagagggagaaaagataattagccccagggtttgatagacatcatttagtagtcatcctgttaatctaaaatcctacacataaccaattaaccattgtaatgagaactttaatttttaaacttcctatccaatttctttcaatcattgctgccaagcatttgaaagccagtaatgcagaaggtgctttataggcctgtgttagaaatggtcacatccccagggagctaaaatcacaacagatcacacaagtagagtgatctgctttttattgtgggcattagataacttcagctttgaaaaaagttgtgttaaggatgaaacccagcaacttttagtgataaaaaaacattttgcaaccattgttcatagaatacacacccaaggccatttttttccttgatcttttgaaagaaattgtactatctgaaatgaattcagataaaggagattgaaggcagtggatgttcataaaattcttgtttggatgtggcaggtctctgggtggtttttgctgtttaggaccttctctgcttctctcccatccacttttctcttgtacctattcttaaagagaccaccctgttagtttagagtgattcatttatactagtggtgaaaaggcattttcatccactaccatgaggtactattaatctactgggccttcataaatttcattgtgaagggacttaatttgtttctattatgagaacttttgagcacattcagttatcataatcaaaaagcacttaactgcatgtgtgctgtgccaagagaattacagagacacattttcttccctctgagtgttcaaatttagcagtgactgccaggttgtgtggatcactgtgtggagggacagaatgatgcatgatcttggagagcaaacttggggctaaaggtatcaggccaaaccagcaaacctgtgtcataattgggagtttcggggaaactagtggttgatgtgagaaatccagccatgctggaggcacaaacagaagcccagtttggtatatgtagactagagaactgcatccagaggattaagcatggtaagagggtacaagactggagtccaaacatacaagcaacttggtcaggattcatttcaggcaagaagaaaccgggaatagagttttagcccagattcaaaacaggtagccatgtcctcctaattacacagccatggtgaaaaatctatattccttcatttgcccctgattttaaacagcctttctcttgtatttggatctggaatactggtttgggctgcttcctcaggtgaggcaggctgctgcagactatgtgtattataacatatactgatacactacagtgagctcttgtaatcttacctttatcttacctttgagacaagattaatatgaacaaaacacttattcaaaggtcagatgatatctagtgtctggggtgtggttgcagtatacatggaccttttcttagaactccccctttcttggcaacgaaatacaaaaatcaggctgacttccaccaaagcagcttttaacatttacaactgaggaaaccaactgatatctaaacagaaggttttttccaatcttttcatccctaagggcaataggcttttcagaaaggcaccttggattgtggtaaactccaatgatcagtaaatctgtccattggtaagtatgaaatcagcccgtttttaaaaaacaatttccaatttttatttatttatttatttttctggagcaaaggcgattattctcttagttacaggacttcatctggacctctagtttgatgacagtagccactatactggtctcaactgggacaaagatactatttctacatagtgtaaacactgacctgataaatagatactactgctcttttagaataaagccaaacataaaccttgaagtaagtgagaggggaggagacaaggactttaggggatgctttaaaagctgctaatttctcttgatgccattattcctctgtgcatgcttaaaggattatcttgatgttggagtaatgatccggagagtatcgtttgtaaccttgggggtagggatggggtgatggggaaactgttctaaataaactctgagacagtcagttcaagaagaaaattaaggctacaccttgagtttgacaaattaagttcttagtgatacttgaagaattaccagtggcctatgttcctaagaaaggagtaagaaggccggacacggtggctcacgcctgtaatccctaaaggccctccctttaggaggctgaggtgggcggataacgaggtcaggagattgaggccatcctgacgaacacggtgaaaccctgtctctactaaaaatacaaaaaaattagccaggcgtggtggcagacgcctgtagtcccagctactcgggaggctgaggcaggagaatggtgtgaacccgggaggcggaggttgcagtgagcagagatcatgccactgcactccagcctaggcgacagagcgagaccctagaacttaaagtataataataaaaaaagaaagaaaaaaaagaagaagaagaaaggagaaatgggagggaaaggcactcatcagttaggtatattttaccttcataataatgttatgagtgtgtatacattatcatcttcattttatagttgagtaaaccggagctcagagaggttaaataacttgtttaaacactgtagttaagaattaggccctaaaggcaaaggcaggtgagcctgtattctggcttcccctaatttctaccagtatgactttgggatagctacttaaactttctgtgcctggtttccccatcaataaaacagggacaataatagtacctacaatcaatcataggaattttgtggatatttaatgagataatatgtataagtcacttaacagtgttccagacaccaactactcaaaaagggtatctgctttgtagttatcaccgttatcagcgttatccttaccccctctatccagatgtgtcagacaccaaagcttatgttgtttctacaacattatagtgcctcctagtggtagcaagagtggtggagccagagaaagtcaatgtgcataagtagaagatgaaaagataaggccatgagaaaaatgagaaaaggcaaaatttaaaaggaagataaaaggagctttatactaacaggtgtaatcactagaagctcacttgtaagcagttgtctcagatgccatactcagtgtatcctgcactagaacaaccctttctctctgaacccctgaggttactagattgtggagaatagaaccccatgtgaccactcaatgagactcatggagaggctttcattaggctttgtttgagaaagccactatgtagagctcatctaatagatctgaaccctaactcaaagacattttcaaactagttccaaggccatgcacatgcaatgaaaaacacgcttaactgtgggatacagggaataatcgatcattaaagtattaattaaccaaatttattgaaaattgaaatcaccccaactgtcaaatgagtcatgctccatggactttctgcgttctaaatattgctcaaatcatgcaaatgttgtgtgaaactgttatgttggccgctttaatgcaatttcacctcatttacatgaattttgatgttgcttagggatattcaatacaacagcacccaacaaagtactcaagtatgtacaaccattggaagagtaatgactgtaacatgtctagatgtacaagaaagctagcttcttataacccagattgagctaaattagcctgatgaatgcatttcccctgctattgttggtttgaccttcatttcaatataaaaatgacagaaaataggaccctttttatttgtttctctagtagtcatcaccatttctactgattcattgtcagtccctactccattcttcaaggcaatcagccaaatgcctgccaccagagaaatccctggttccaagcttaagtcaccttcataagtactgaagtgcaacatacaaaactattggacagcagttgatgaggatttaatcctttttggacaggtggcacttttaagttctgggtagaaaattcccacattttgagatctggaattttgacctggtagagcagctgataccttaaacaaagcagtgttctctttattcactaggtggcaggagctccttaatatatatgtgagggatggctataaacacatgtttagactagtgcatcagtaaagctgtcttttagagacagatacatgaaaatgtgagccatgaaatattaaaccagagcctatgagaaaagaaatcctctgtgttaaccacagtagcttaggatttaatagtagtagaacaaggtgattgtttctttaaataataacaatttgaagaaattccattagtaggtttgtcaaaatgaagtgaattaataaaatactttattcctatgtgttttgctgtttgaaaatttacttccttcaagtctctgctgaaatgtcattttatcagcaggggcttaccctctcttatactccataaccctctgatgttgctttgttttactctacagtacctattacattctgacatactttatattttacctgcttttttatttaccgagtgtctcccctatcccctctggaatgaaagctctatgggaacaaggactttgttttgttcattattgtattcccaacacatagaacactggctggcagataatgggtgctcagtatacattcaagtgaatgcgtggaagaattaccaaaaggaaattatttttaaaagataattttaaattcaacttttaagtcagcttgtatataaagccaagctgatttgtatataaagtcaagctgacttaaaagttgaatttaaaattatcttttaaaaataatttcaattataatcaaagtaaatcatattatagtatacatattttaattttgttttgctataatcataaaatattaaatactatcatcacctaaatggatgtctttatgttaacacttgatggtatctaaggtaattaatttttaagtaattatgccaaatttgcctgctgtttttatatcattaatcaagataatgaaccttgtcattgataacactatgatttactagtattttgctctttaatttcagtttttacttctgttttgagtagtagtataatattttagaaaaataaggaattaaaatggtgataaaattaggtgaatttagagaatgcctgtattgttatttttaaaatatccaaactgcctctacaagtacatctttgaagttttggttgtagcatggtaaagagaatcttagcaaccagataacttttgaaaaaacactgaatgtttccaagcttcaatttccttatctataaacacaagatagtaatttctgtcctgcctattcataggattattgagatatataaaaattatctgggaaatgtaaaattctattcaactgtaaggagttatagatgatgctagtaagtaatttaatttgtctaatgattttaggagctacagcaatcccactcctaggtatttgctctgaagaaaggaaaccaatatattgaagtgatatctgcattccaatgtttgttgcagcactattcacaatagccaagacttggaagcaacctaagtgtccattaacagaagaatggataaagaaaatgtggtatatatacataatagaatattattcagctataaaaagaatgagatcctgtcatttgcaggaacatggatggaactggaggtcattatgcttagtgaaataagccaggcacagaaagacaaacttcacatgttctcacttatttctaggagctaaaaattatagtaattgacctcatggagatagggtgtaggatggttactagaggctgggaaaggtaatgggggtggggggaagtggagataataggtataaaaaatagaaagaatgaataagacctagtatttcctagcacaatagtgtcactacagtgaaaaataatgtacattttaaaataacataaagagtataattgggttgtttgtaacaaaaataataaatgtttgaggtgatggatatcctgtttacccttatgtgattattatgcattgcatgcctgtatcaaaatatctcacgtaacccaaaaatatatacatctactatgcacccaccaaaatcttaaaaagtactttgtttttaatactctcttgtaggactttggatatgagcgctgtcttagctcaggttgccataacaaaatacaattcactggatgacttcaataacagaaatttatttcttacagttctggagtctagacgtctgagatcaagtttccagccaattgagtttctggtgaaggtacttgtcctggctcgtagacaactgccttctcactatgtctttacatgacctttccttagggcttgtgtgtatagaaagagagacaggagttctccagcatcttttctaataaggtcactaatcctgttggatcatggcatcacccttatgacctttttaaccttaattacttctttggaggccctatctccaaatatagtcacactgaagggtagggcttcaacatatgaatttgggggaaacacaagcattcagtccataaccaacaccaacagcatcagcacaataatgttcataataactttttttgagcactttttttgtgtgtgccagttactgtgataagtactttaaatgaactatctcattgtttcagtcagttatttctgtggcttatcacaatcacttgaggaccagtgagaggggcttttctccatgtaattatttaaaacctaggctctttccgtcttgtggctgtggcctcctctgagttctagaagttctttctatttagccggtgaatgggaaaagaaaataaggatagcacatgggaggttttcatgggccatgcttagcagtgccacgtgaccgtttttcattagcaagaatttagtcacatggctatacctaatagctgagaaatgcagtcaacctgtgtgttcaggaggaggagaaaagggcaatacagttattagtgtagcattagcagtaactagcatactcatttaatcttcatagtaatctaaatcggtaggtaccatcattgtccctattttaccaatgaagagaaggtatttgctcagtgtcacactactagtaatttaaattgaaactcagtctccttcagagggttgcttttaatcactgtgctcttctttctgaactaggggtaagagtattatttcattgctatagtgaatgtttgaaatgtttgaccatctctcagagatgttttaatagatcaaaaattttgtttagttataatttgtttagttactaaagaaagaagggaaagaaaaaaggaaggaaggagaacaaataaggacaagctttttgtggaggggttggatgctgtttcttatatgcaatcatgtatacttgttaataccattaatagcttattcacctttagggtctttttccttattgacataatttttagagatacttcgaatgtgtttagtgtttggctgtgacatcaaagtatatggagtcctttgcctgtctctgcctaactacctcttcataagggaggttgtactgtccagagagaccatataaagtcatcttagaatttaaagtcatttgtccatattgagcacaaattggaaggtcaaggactaggatactgcttcccattgggctaaaggattcctgaagtgatctaaaacaggagggatgggaaatctcccttcccttttacctaagtggttacaggactaaactaaattacagtaggttgccacttgttttttgcatcttgatgggttttatagccacctggatggggctgcctctccaatgtaccatgttgaatggtgcattgtttgatttacaatgttcaacaaacatactttcttaaatctcttctgatattttagttgaaagttcattttctttttatagacagcacaatactatcctaattctagctaagttatgataacaaactacagaatatgaacttctaagcttctaaaagttatcttcataccattcagatggtatgcttcttaaaatgccaacatattacaaagaccatttaattcagccttcttgaagcacaagaagaaatgatctttctagcaaaactgttttcctgccatactaagtcgaatttctccaatactataagagttctggtagcttttgaaaaaagtagtagagtgggggataaactgtttagacagcatgaaataacttaaaattttcctgcttatattgaagagagtagcaatctaggatagtttcatcttaaaataaatttgtgttctgtggttgatagtaaaggggtagtagggaagtgcccttgactaacttgttccattatcaaaagccaagtcaggatttttgcatgtgcatatataagtggccaaatgagagttcatagacaatgatattacattcggctttcttccggcagtgttgatagtaataataatacggatcaggcctgtcttaccaatctgaaacaccctataatctgaaaaaacattgaaatcagacgtgtagaactgaattagagatgtgtgggtattaaaatactccatccaacccatttccacatgtaccatctgttgtttccagatgcactgcttcctagaggcagtattcatgggcatggcattataacaccaacaaatcggcatttctacttctgggacttaattcccagaaatacaagttttcattggctgcacttcagggaattagacttttctgtggctagggacatgccattacaaccatggtaatggaaatagaccaatttagagcatataaggcagcagggtgccttcaaattggaagcagtacaaagtttctctgatgtgtctgtaactcaaggtaagttgagtaacactattaatgttccccccttggtacttagatatgcctagcacattgcagataagttgttggaggtacctcttctatgttaagtttgataagtgaagttataaaatgcttcaaaggctctggagtatatgcttaaagccatgtatatagtccagcaccttaatctgatgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacaaaaggagtcttcctggaataaagtattttcaaataaatggtaagataagtgtgataatctcctagactcacattacacataaattagtttgctatgaataattatttccaaaggcttagtgtgcattgaagtaaacgtttagaaacagccagtttgaaccatttaaaaaatatattttggtttaaaataaggaaaaaagaaatgctttgggactagcatatatggtcatgatggagtttatttatttgtagccatagtatttgaatgacatcttttgatatgctttaaaatttcttgttggctggaaagtaaagaatcatgactacagatgtcaagtttaactgccttcctccaaagtgagtcaaacgattcttatgatgtattgattctataccactaagttactaactatgttgtgggaggaacctgcctcctcaagatagtgcagctttacatcagacagggacatcaaggtcgtcatgaaggggaaatttaagacatggaaataactagaacagctgggcaaggttaaagcactctggcatgcactggcgaaagcagggcagcaaagcctgcgtctgtaagcttccagaagaggtgaaaaatccaaagctttggaccacttttctgcggaaaaggtaaagctcaaactgtcgtattggatctgtacatgctactaccttattttcttgaaatttgaacttgagacaggtaagaagagtactgactcaagtgtagcgagaggttatttttaataaggattcatatttaaaagtttagttaatcataggactggacttccacagagttaaaaaaataaattctaaatagtaatttttaaaaatcatatttggattagatgtaaagtgatctggggctgtaatggatatttgtttaaagttatttcttcactaatctgttattagccaaacctgatgaggtcatgtgtcgatttattggcaggatcaaaggaacacatttatttaaggtggtatatttgttgatctcccccagaattctctagatgtgagttgatgcaattcaatagctattaattccactttaataatgagtttgacatttatatttttacaatatcttaaccagccttttcaataacatgatccaatgatgcagaaatttgtttctaattgtacaggccatcattaacattgttgtttaccctgaaggcatttgaatgcccttttgaaataaaagttaagggctattttgacctagatctttaaaaacaagtaacacttttatgcaaggacactggttaaattgtggggtgcagacaaaaatattcaccaactgtcaaaagaggctgagaagttatttccactccaaaacgtctgtaattcactaggttagacaaagaggcacattcgtgaatcaagggaattgttttataaaaatgatgttttagaaaattgccttaacatcttacacactttaagtttggaatcaagaaattctgccttttacttacctgtcttattaattgttttaaaatactgaaaatatatacatatgcatcatggatggcagaaaacacatatgacttggcatgacagttgcttgaaatggaaaagcaatacaatgactttgtacttttatgaaacacatagattggtaataaagctgcttcctagtcgcatttggtcgccacaacacccaagtgatttgtgtaattattgttttatctatctttttaaacagtggaaaagtcagatgaaccaaatgacccagtgctcatttttattgttaccatccttctactagatgtacagtcatagtcatttttaaaagaaaatcctgacttttcttatcatatccaaaaagcacgtcactaaattctcatatcttgtgacaactgataaataatagctagagtgtattttttacactaattgtgattttaaacaacattaagaattggttgcttatatggggtaagttgaaacacatagataagcccttttaattgaatacttggaactacacaattccaaattagtcatgtaatattttaagaagagaaagatacacgcattgggtgccttctctgggccaaacactgtcacacatgtaatggcaacttcagaacaacagtgtgcagtagttatttttatccccatttttatggaggaagaaacccaacctcaaagatgttaaacagcttctccagcatcacaccagctactcagtggcagagccaatattcaaatgtacatctgcctgtttttaacttctacattacaaagcatttaaataaatgtggaaaatatgttcgataataatggctaaatcaaaatgcattggagtaaatctgtgtagtactgttcatcaaggtaaaagtatgcattttgtttgttaaattgttttatacaagacactggaataaattaaatgcatgagtgatatcagaatttaaagcattgtgtttattaatgttgttttataagttacaattatttaattgaggagcagtctacaaaaatatttaatggcaaaagtagagttaagttatttgcacccacacattcataaaattttgttttgtttttttaagacagggtctcactctgtcacccaggctggagtgcagtgatgtgatcatagctgactgcagcctcgacctcatgggttcaagagatcctcttacctcagcctcccaagtaggtgggaccacaggtgcacaccaccactcctggctaattttatttttattttattttattttattttatttttttgtagagatggagttttgtcatgttgctcaggctggccttgaactcctgggctcaagtgatcctcccgccttggcctccaaaagtgagggacttctgggggtgaaccaccacacccaaccttggtttttaaagctgggatttctatttttcacaaccttatttataaaacaagccaaataccaaaattgaaaaatgatatggcttcatttgaactatctgttgctatgtgtaaggaccgttaaagatattctggtacaaattactctttaaaaagagggcttaaattaagtatgttcagttgtgtaatgtacttttggctttaggttataatgcaatcagttattttgctgtgattcaatatttacatgtttctgctgaagaaaaagcccagtcactacagaaagaaattgtatgattctacatgtgtagaaatcttgtgatataattgcattctcattatgtcttctactagtaatttatgaatattcaagatttttattttatttactttcaacccaaatgatatttttttctgcagaataacagaaaaaacttaaccctagaaatgactgttttttaattaaaaataataacccttccagaatatagagaaaaataagtttctacttattcaccaaataaataaatgctgactatcataaccctttaagtctgtatgaccttgtagttctataacctccctgaacccatagttttcttaactatgaaatgaggtaataactacttccctgggttactatggttgatacttaaatagtataatgcatggaaaggataaagaactgtgcctggcaatgagtaggtatcaagttgttattgaatcagttaatttgttgtgcatataattaagcaatttggaaatatgatttaggaacatcttataatctgacccagaaattgattttaaaaatgaatgaaatttcaattacagtgaagttgcttatcagattcccttgatagcttccccaatattgatcgaaatgatctagacctctcaggagcaccctccttcactaggtcttagccctatactccctctcttgtgttttactggtttccttctcacagtaaagcattttgatatgggtgtttaacatgactattttgatggagtcatattgacataaccacatccaaatatctctatattaaccattaatatattaacaggattatattaaccattaatataaaaccattggccattggtttctttacccaaggactgtgtatcatatcagacattttgaacttagttccatctcttagtatcccccagcagacttcatggttctttcactttctactttacccatttttgttttaagagacagggccttactctgttacccaggctggaatgcagtggcatgagcatagctccctgcagcctcaaactcctgggctcaagtgatcctcctgcctcagccccaagagtagttgggactacaggcatgtgccgccacacctggctaatatttttaaattttctaagacatggggtctccctatgttgcccaggctggtctcaaattcctggcctcaagtgatcctcctgccttggcatcccaaagtgctggtgattacaggagtgagccaccacatccggccttacccataattgtattgcttgactttttattaaaacttattgcttttgtagtcataaaaacagaactcttttaaaaatgtttacaactgagtcaacctccaaggggagggatgctttttacccaaaaactaggattgtaaaacagtgttacctcatagtgtatatatgctactgtagaaattgttagagaaaattttctcataccccatccccagtgtcttacgagatttgaaaaatcaagaagcctacacaaataagtagccatttaaaaatattttctactggaaaatgggacaaattccacaattacattgctaaatctgtatttcagtagagattaaataagtatggcaattgtaaaccttaagagattagacaatttagaatggtgaccattcagccaacaacataaattatggctgctgcccctttgtgagaaaatcatgtgtgataaacatgtggcccctagttttatgtcgtgtggatgccacatggtgccttatcccaacctcgttccctaccccatttctgagcttcttgtcatttcatagtcttctggtatatagatcagggataggatgaggtccaaagataagaatgaggatgtttgtttcacatactgcttgatttaaaataatctgactataaaccttgtcacgttatcaaaatatcaggtaccctattccattctttgctgtacacttgtctcctcttgatattgctaaatcatgaataataaagaatatctattaagaaatgtgcttttgagactaaaagttaaccccactttaatgataacatgttggaaaatacagtggaaaggctagaacatgtgcagaggataccatttactcatgccataatgagaaaaatatgaccaatttggaggggtctttgtgtataaaacaggtctctttgcaagagacctgttcaactatacatatatgcagcagtaagcaaatatttgagtgagtagaataataatagcaagcaccgatgtgggattaactggtgatatattttataaggccacgttcatcatggtatatcccatacaacaggcagatgttaagatgatgtcaataattatgaatttgttgagcacccatgagtaatttgcttttttaacataatggattgaacacattttaattcttgccttttaaaggcttccatatgaagccttctaaaggggatcacataacatgctaacatacaagtgattgtaaagaagaattagttttgaaaatgttgttcagataagaacacatggacacagggaggggagcaacacttactggggccgtgtggggggcaggttgggggagggcattaggtaaaagagctgatgcatgctgggcttaatacctagctgacgggttgataggtgcagcaaaccatcatggcacatgcttacctatgtaacaaacctgcacatcctgaacatttacactggaacttaaaaacatacatagttagaatgagaatgacatgaaattcattaaggttgacatttaaattcatgaggttatcaatgcttatatacttattaaaatataaagttgtttacggtaaaaaaaataggaaatgttgttcagacaagtatttaaatattgttagtgcgtaggactgatacagactgggttaatctggaaaaagtctcttactcaagggaaccttaaggtgaactttctgggaaaaggttatgttatttagacagacttttgtagtagaagtattgaaggctgctcaaggtaccccacaatttatattattttcttattctagagaggaagagtgttgtcataaggaaaagttaatgaagaaagaccgacgtaggatttggttgagtttagtacatgctgatactatggtagcactgtatcataaactagtactataaagactattatatactacccacgcaattataagatgacacccattcatttccattttcatcatcttcattttttttctaggatatttgtagcttataaaataggataacctgattaaatttagtcctttgaatcacgaattctagattatttcctttttaattctgggagaacttaagccatctgttgccttgaagcagagagatttagtaatcaggcagagcagtaagaagatatttgtctagggatattattaattaacaaacttggaaggtattcttcattttttaccttaaagtcaaagtacccccaataagtacattggggaattaggctagaaaacctgtcttgggtcagatactctttgtgttctgctttgtatagtgcagaagaaaatgtaaataggtgttgggtccattacgatgaaaaaaaaaaaagcagtaaataacaagaattgttttttgtgaggtcccaaaatagtgcacatttataaaaccccaatatttcaaaacaaatattatgttgtttttacataatccttttcacttaaaaataactgttctcaccacagaggtgataactgtttaaggtgatggattttttgattaacctatttgatcattacatcacattgtaccccataaatatgtgcaagtgttgtgtaaattaaaaataaaataaaacattaaaaaagctgttgtagtgtcctttctacttaacttccatattaaaattgaaaatttcaacaacagtttttgaaggaactagaacaagtttttttaaatcaaatttatttaagtacagctattttgcaattaaatggacccattttaagtgcatacactgatgagttttgagaaatatatatacacatagagtcaccacactacccaacacataggatctttccaaaaccccatgaatttctcttctgcctcttcccagtccattctcattatcccaagcctcagggaatcactgatatactttctgtccctatagattagatttgtcttttctagaatttcatatcagaggaataatacagtatttacttttttacatatgagttcttaacactcagaacagggtttgttttggttttgtttcagtatcttttcagcacatagtattattcttaatgttagacgttctaatagatgtgtatcagtattttgttgtgattttaattttcatttcactaataactaatgatgttgagcatcttttcgtgtgcttaatggccatttgtgtatatttttggtaaagtgtcacttcaaatgttttgcccattttaaaatactgggttgtttatcttcttattattgagtcgtaagagtcttttatatattctagatacaagtcctttgccagatatatgtattgcaaacactttctcccagtgtatggcttgcctttttattttcttaacagacaaaaacttttaatctttatgaagatcaacttaacttttttttctttaacagctaagtgctttatttttcattttctatttttatatatttaggggcacaagtgcagatttcttacatgcatatattgcatagtggagtagtctgggcttttagtgtacccatcccccaaatagtgaacattgtacccaacagttaatttttcagccctcactccccgctcactctcccatactttgtagtctccaatgtcttattctgctctatatgtccatgcataccctttgtttagttcccacttagaagtgagaacatgtggtatttgacttccttttctgagttatttaatttatgataatggcctgtggttccatccatgttgctgcaaaaaaacatgatttcattttcttttcatggccgagcagtattccatggtgtatatatatataccacattttatttaccctgtcatccattgatggacacttaggttaatttcatatttttgctattgttagtgttgcaataaacatatgtgtgcaggtgtctttttgatataatgatttatcttactttgggtagacacccaatagtgagattgctgggttgaaagataggtctatttttatgttttgagaaatattccgttttccataaaggttgtcctactttatgttcccaccaatagtatataagcattcccttttctctgaatccttgccaacatttgttgtttttttgactttttttttaaattatagtttaagttctgggatacatgtacagaacgtgcaggtttgttacctaggtatacacgtgccatggtggtttgctgcacccatcaacctgtcatctgcattacgtatttcccctaatgctatccctcccctaatcccctaccccctgacaggccctggtgtgtgagtttcccctccctgtgtccatgtgttctcattgttcaattcccacttatgaatgagaacatgcagtgtttggttttctgttcctgtgttagtttgctgagaatgatggtgtccagcttcatccatgtccctgcaaagcacaagaactcattcttttttatggctgcatagtattccatggtgtagatgtgccacattttctttatccagtctgtcactgttggacatttgggttggtgggttggttccaagtctttgttattgttaacagtgctaaaataaacatacgtgtacatatgtctttatggtagaatgatttacaatcctttgggtgtatacccagtaatgggattgctgggtgaaatggtatttctggttctagatccttgaggaattgccacactgtcttccacaatggttgaactaatttacactcccaccaatggtgtaaaagcattcctatttctccacatcctctccagcatctgttgtttactgactttttttttttttttttttttgagacagagtcttgcactgtcacctaggctggagtgcaatgacacaatctcagctcactgcaatctccatctcctgggttctcatgactcttctgcttcagcctcctgagtggctgggaatataggcgcacaccactacacctggctaattttttgtattttcagtagagacggggtttcaccatgttggccagactggtcttgaactcctgacctcgagatccacccgcattggcctcccagagtgctgggattacaggcgtgagccaccatgcccagccgtttgctgactttttaatgatcgccattctaactagcaggagatggtatctcattgtagttttgatttgcatttctctaatgaccagtgatgatctttttttcatatgtttgttggccacataaatgtcttcttttgagaagtgtctgttcatatcctttgcccactttttgatggggatgtttgttttttacttgtaaatttaagttccttgtagattctggatattagccctttgtcagatggatagattgcaaaaattttctcccgttctgtaggttgcctattcactctgatgatagtttcttttgctgtgcagaagctctttattttaattagatcccatttgtcaattttgggttttgttgccattgcttttggtgttttaatcatgaagtctttgtccatgcctatgtcctgaatggtattgcctaggttctcttctagggtttttatgggtttaggttttacgtttaagtctttaatccatctatagttaatttttgtataaggtgtaaggaagtgtccagtttcagttttctgcctatggctagccaattttcccaacatttattaaataaggaatcctttcctcattgctttcgtcaggtttgtcaaagatcagatggttgtagatgtgtggcattatttctgaggcctatgttctattccattggtctatatatctgttttggtaccactaccatgctgttttggttactgtagccttgtagtatagtttgaaatcaagtagcgtgatgcctccagctttgttctttttgcttaggattgtcttggctatatgggctcttttctcgttccatatgaaatataaagtagtttttttttttcgtaattctgtgaagaaagtcaatggtagcttgatggggatagcattgaatctataaattacttagggtagtatggccattttcaagatattgattcttcctattcatgagcatggaatatttttccatttctttgtgtcctctcttatttccttgacaagtggcttgtagttctccttgaagaggtccttcacatcccttgtaagttgtattcctaggtattttattctctttgtagcaattgtgaatgggagttcactcaagatttggctctctgtttttctattattggtgtattggaatgctgtggtttttgcacattgattttgtatcctgagactttgctgaagttgctcatcagcttaaggagattttgggctgtgacgatggagttttctaaatataccatcatgtcctctgcaaacagagacaatttgacttcctctcttcgtatttgaatacccttcatttctttctcttgcctgattgccctggccagaacttccaatactatgttgaataggagtgaggagagagggtatccttgtcttgtgccagttttcaaagggaatgattccagcttggccattcaacatgatattggctgtgagtttgttataaatagctcttattattttgagatattttccatcaatacctagtttattgagagtttttagcatgaaggggtgttaaattttatcgaaggccttttctggatctattgagataatcatgtggttttcgtcattggttctgtttacgtgatggattatgtctattgatttgcatatgttgaaccagccttgcatcccagggatgaagccaacttgatagtgttggataagctttttgatgtgctgctggattcagtttgccagtattttattgaggattttcacatcaatgttcatcagggatattggcctgaaattttctttttttgttgtgtctctgccacgttttggtatcaggatgatgctggcctcataaaatgagttagggagaagtcgctgtttttctattgtttggagtagtttcagaaggaatggtaccatctcctctttgtacctctggtagaattcggctgtgaatccgtctggtcctgggttttttttggttggtaggctattaattactgcctcaatttcagaacttgttattggtctattcagggatttgagttcttcctggtttagtcttgggagggtgtatgtatccaggaacttatccatttcttctagattttctagtttttttttgtgtagaagtgtttatagtattctctaatggtagtttgtatttctgtgagatcagtggtgatatcccctttgtcattttatattgtgtctatttgattcttctctcttttcttattagtctggctagcagtctatctattttgttaatcttttcaaaaaaccagctcctgggttcattgattttttcgaaggttttttcgtgtctctatctccttcagttctgccctgatcttagtttttgaatttgttttctcttgcttctctaattcttttaattgtgatactagggtgttgattttagatcttttctgctttctcctgtgggcatttagtgctgtaaatttccctctaaacactgctttagctgtgtcccagagattctggtacgttatgtctttgttctcatttgtttcaaataacttatttatttctgccttaatttcgttatttatccagtagtctttcaggaacaggttgttcagtttccatgtagttgtgcgattttgagtgagtttttaaatcctgagttctaatttgattgcactgtggtctgagagactgtttgttatgatttccgttcttttgcatttgctgaggagtgttttacttctaattatgtggtcgattttagaataagtgctatgtagtgctgagaagagtgtatattctgttgatttggggtggagagttctgtagatgtctattaggtctgcttggtccagagccgagttcaagtcctgaacatccttgttaattttctgtttcattgatctgtctaatattgacagtggggtgataaagtctcccactactattgtgtgggagtctaagtctctttgtaggtctctaagaacttgctttatgagtctgggtgcttctgtattgggtgcatatatatttagggtagttagctctttttgttgtgttgatccctttaccattatgtaatgcccttcgtctttttttggtctttgttggtctatagaccgttttatcagagactaggattgcaacccctgctttttttgctttctgtttgcttggtaattatttctccatccctttattttgagcctatgtgtgtctttgcatgtgagatgagtcttctgaatacaacacactcattggtcttgactctttatccaatttgccagtccttgtcttttaattggttttaataataaccattctgactggtataatattgtatctcatggggttttaatgtgcatttctctgatgattagtaatggctagtggctagtgcttttttgtgtcctgtgtgttcttgcatattccaagatcatgacagttttccgctgcattttcctctggtagttttatagttttagcttttacatttaggcctataatacattttgagacaattttttatctggcatgaggtaagagttgaagttcaatttttccttatggttattcagttatgttagcaacatttattaaaatattatctttttctcattgaattttacctttgaattttattcaaaaaccatttaaccatatacaggtggatatatttttggactccctattttgttccattagactatgtgtagtatatgctgatactacatatcatgattctttttcaaaatcatttaggcttttctaggtcctttgcattgtcatgtaaaaaattggctcgtcaatttctaccacaagagcctggggagattttgactgggtttgcttagaattcatatcattttgaggaaaactggtatcttaacaagttgagccttccaatttataaacgggatatcactccgtttatttagatctttaatttttctcaatgatattttctgctttctagtgtacaggtcatgttcttttgttaaatttatgcctatatataataacaaatttttaaaaattaaatatcaagagagaagagacagtgaaacttatccaggagtgcagcctgttttcgtaaaattaatttgtgattgacaccaacaagccttctgatctgaaatttcaagtgttctggtgagtaattggaatttgtgtatatctttttttctaagctttttatatcaatgtcttttaaggaagcaggcatatattctcctcaatgagaatctccaaatgagccttttactttcccctaaggtttggcttccttatgtttgactattgccttatacatgttatttgttatacatattatacatgttgtttgttcattgacttattggcataaaggccataaaaatactttttcctccttcagaagtctcttccacattaatagctttatctagtagctcagttatggaaactcacaagcctacatctcgagcccaatatttatcaaaactctagttgtaaatcatctattttttgctgggtgtttccatatgtaaaggtttgttaatttaagcatatctgaaaccaaacacctctcccctcactcacacacacacacacacacacacacacacacacacacaatttcattaaacaaacacattgctactatctggtacaaatagatgagtttaaatcctaatgtaaaagacataaatggaaacaaagtttcattgcataatctgaaaaattgcataataggggtaaagaaagattattatggaagcatctaactgttactggtgggttcaggcacttcacaaagaaggtgatgcctaaactgggacccctcaaatccatttttgttcatcaggttgaataaatcataaaataattttgtcattcataatgttagtccactccatgtttgaaaaattgtagttattctcgattcttttctttctcttgcacctcaaattcagtcagtgaatactatcagttttatgcattgtagcacggtcattaaatgtgttgactctaaaactattcccactgtatttgaaacctgatcccagtccttacttgttgtgtattttggcaagttattcttcctctctgtgcatcagtttatttttctgtaaaatgcagttaataattatacctacctttgaatgttaatataaggataaagtaagatagtaaatattaattctttacctcagtgcttagcccatagtgaagtattcaataaatattcacagttatcaataatattgttatggcatcacttaaatattttctttcctttccaacacccttgaaataaccctggtcactcttttatttatttatttatttattttaatagaaacgaggtctcactgtgtcactgtgttgggcaggctggtcttgaactcctggactcaagcagttcttctgtctcatcctaacaaagttctgggattacaggcataagccaccatgcccagctccccaatcactctttacccttgctactgtagtactgaatccatattcaaaaagttcatatgtatgttgattgtttaggtgcaccgcttgcattttctcatagaaacagtgttgtgaatgatggttaaattaacaggccagtccagcaaaaactaatttaatgcaaatctgttaaatatattatcatgttgagtcctctataacctagctattgcataataagtgtttttcgattattcaacaaatatttagggagtacctaccatgtgcccagaactatttggtgcttagaatataccagtgaacaaaacaaagattctgagcttgaagagctaatgttctaaaggtagaagttaggacttctttacaatcttacagccttctgccactactttctaaacttaaagcagacacacagctttttggaagacttctaaggcatttccatggtaggattctaagaaagacaacaaatgtttaaagaggctcccttccatactttcttattctcttggttaattttgtctctggagaaacaaattggcacataaaaattagcactggatctttggctattcaaaatgaagttttagcttcatttgagaggagaaacaattttaagctacagaaaggcatttttttctgcagaaattggatgggacttatgctgtcagtgaggacccagaaggaaaaaaaaaaatgggataggggaaacagcagctaggacagtgctggtgagagcatcttctagggctttattcactattcccttttccctcaccacttcagccttgccatttcagactctccagtggaatagcctgaatgaaaagacaagaagagaaaaatacccataagcatgggaatgagattttaagcttttgggatggaaagggaagggaaggaaatcacagaaactggctctagtaaaggatgtcagtttctgtcctcaaatgcctccagggtatataaataagtcagaaatacccaacttagattttgacagcaaacagacctgggtttgaatcctagctcatacatttatgacctttttacgtttggcaagttatttaaccactctaattctttgctttctcaattcagagttaatgagagggagcaccttatggatatgattcttgctaggattgaatgagataatgtacataaagtgcttataagagtgactggtacatagaaagtgcccatccatgaaaattagttcttttcttctgtcccataagaattaatttcattgtttcataaacatcaatgcatcctttccttccccagtccaaactatcctagatactacagcttagaaatcgcttaaaacaccttttggatctgctatgccctgccaaacaatctccaatggatccccatcacctatggggtaaagtttaaacttaggctagtattcagagtcctccacaatctgagcccgactatttcctctcggcaatcctacatgaacattttactcaagcccgatttgtcgacactagtgtttctctaacagaactcagggcttgttgtttaaggatagagccttgattttgccgggaggctagtggtatgatggtgggggtgctgatagcatttcaaacaggggagggcaggatcagagaaaaaccatgtttctcttttctctctctccctctgtcccatgaagtatgcctagattgtcttagccagaaagtgtttctttaaaagaccaattactgttcctgcgtgtttgggggagtggggagggcgatgggaaggagagcatcaggaagaacagctaatgggtgctgggcttaatacctggatgatgggttgatctgtgcagcaaagcaccatggcacacgtttacctatataacaaacctgcacatcctgcacacgtacccccgaacttaaaataaaagttgattaaaaaaagaccaattactgagtcccagttctataagtcatggtgctaagaatgggcactacagtgcttcctccttgattatgtaatcacaaagaggagaaagacaaatgtttttatctaattgtaatatgatatgattcttccaggtgtatgtgtatgtgcgcatgcatacgtctgtgtgtgtaagtgtgtgcgtcatgtagacacatgaagggaagtgtgacaaattgatgtaagtaatcatttactaagatggtaacatttgaatgggaacttgagatatttgacattccagaaacaacaagcacaccaagtaatggaaagaaagggaggacatttgagacaggggagcagaagatgcaaatgaatagaggtgtgaaagagtttggtgtgttcagggagtcccacaaagtctaatgagactttagtacagtcttgggataagaagggagttgaaaataatgataaatggagctctgaaggtaggttggagccaatttagggattaaattacaatgataattgtaattatcatttattgaacacctagtatgctctaggcactgcgtaaaatgctacatatatgtgtatatatatacacatctgtgtatatatatatatacacgtgtgtgtgtgtatatatatatataatcatttttaaagcccttttttttgagacagagtctcactttgtcactcaggctggagtgcagtggcacgatcttggctcactgcaacctctgcctcctggggtcaagcaactcttgtgcctcagccaggtacgaccatgcccagcgaatttttgtatttttagtagagacggggtttcaccatgttggccaggctggtctcgaactcctgacctcaggtgatctgcccacctctgcctcccaaagtgctggcattataggcatgagccactgttccaggctaaaaagctttttatcaatcatatgagctataagaaatattattatccctatttaataagtgaggaaactgaggcaaagattaaataagtgttcaaaatcaccagctggaaatggtagagccaaggcataaacctaggtctataggaccgcagagtcaatgaacatgaatgaatgaggcattgccaatggtgaggtgaaaatagagcagagagattagactctgaggcatcctctgagatagaaagatagtgttaatgtggcctggtaacttgtttggtgttgaaggctagagtagaggcatggagtatggagggtgactctaaggtttctaatttgcgagatgtcataatctcattagcagagatggaaaatttaggaggggaagagtggtagtgggagcattaatacatttggatttgtatgttttataaacttcaatatctgaaatggactgaaggtagtcactagacttataaatacaagtcgaaaggtctggacagaatatagagacctgggaccacagcatttgggcaatagtaggaggtgtgattatggataaaattacccagggggaatgtataaagttagaagagcatcagggatggagtacttctttctctgaaacattttacattctccttgtgaaatagcataagcttcctagtgttatgtagttttttttaaacctctctgatctctatcaaattatcagctacttgaggacagagacctccttgatgaatttctacaaactagccaacatttagcaaagagccttgtgcatagtgtgaattctttttattggattgtcccttagcatgggggtgttagggatgggactctgaagtacctgtgagaggctttgggttgtcagctaggagctggggtgagagctatacattgggagcaatggaggtgagaagaaggtgcctaccactcagaggttgggctgttttccccatttaaatgtggcaatatagttatgtcaaaaagtataaatgttgtgttttatcaagtaaatattcttaggcttgctgttggataaaatttggtggagtcagggggaaatccttcaacttatgctttaaatttctgaaggaaacttccaaatgtagtaaaataacaatctgagcttgtattcatttttaaatttaggaaaaatatttcaatcatgcattacaatatagctgtttaaatgaactatgattctttcagcatttgtgaaataaataaaacagggcactgaataaaaccggagtattgttatttcactgttgctaaaagacaaaatcaatacttgattactctgaattagtatatccaaccacgcaaatctttaacctcagattaactaaacataagaccgtgacccaacctacaacagtaacatttagcaatagagaatgaactggtgctgagcctgtttgtaaagcttggagttgcactgatgtccaggctagttttctgactatcattctgtctgaagtagctgcagaattatgtcagcagaattttaactaactggcatttctgtgaccgtttcctttctcctactcctactactcattttataacacagcttataaatgaggcctttcctcagggaaatgaaaggcctcagtgatactttgtatcacattaaaggttgttttctttgttaatattgcaaagagttttacaaatggccatttctcatatccctaactgttcattaaatcattcaaaatttaggctgggcgcagtggctcacgcctatgatcccagcactttgggaggctgaggtgggtggatcacgaggtcaggagatggagaccatcctggctaacacggtgaaacgctgtctctactaaaaatacaaaaaattagccgggcgtggtggcgggcgcccgtagtcccagctacttgggaggctgaggtaagagaatggtgtgaacccgggaggcacagcttgcagtgagctgagatcacgccactgcactctagcctgggcggcagagcgagactccatctcaaaaaaaaaaaaaaaagttattcaaaatttaaaacttacgtattgattacctgctatgtgtcagatagtatactaaacattggagctataagtagtctgcaaaactggcaaggaacctatacatacattctatactggtggagacagataatatacaaacaaatacgtaagtgaactaaataatttcaaatagtgattcataccagacaataaaataagataatgggaaacagtgattttgtggtggtggtagtggagagctgggaaacattaactaagattattaaaaagccctctctgaggaggtaacatttgagctgaaacctgagtgatgagaaggactcatttaggcaaggatgtgggagaagaggatcccagacagaagtaacagcaggtacaaagttttgaagcctggaatgagtgggcgggtctatggaacagaaagaaagccattgtgaatgaagcaggtgtgagtacatgatttgaaaatggagaagcagtcagagttcagatcattcagggtgtcatggaccatgataggaagcttaaatttgattccaaggaaagtgggaagtccctgttgggtttatcactctggcttctgagatttgcctcagggccttcttgtttcctggcatcctgcttcttcctgtagcaaatcctgcctgggtttcactagcctggagaagtgattagctccccagtgatctagaaccatcctttctgtgctgtcactgtccttccctgacttcacctctccctgcctgggatctgagggagacttccttatttctgtcaacagaggggcctttccagaatttgtggatcaggtcagaaaaagattccatccttgaaaggccacaaaaatcttcctggtgtagatgagtgcaatttttttgcagcagcacccctcaggcagatgtatgaaagtgtagctgcccaggtgagaacatgtacccaggaaggcctccatctcagaggaaattcatgggacatctctgcagtgtcattgatttcaacatactcttcacgagatgtcaggatgatggaagctgttggtgtttaataagaaattttgaaaaaaagtgagctagatagaaatctgagatttctgcatgccttcagcttggtccaaggctttgcgtccttagaaaggcagtctctgtggtttgggattccaccagagtggagtaaaaatgcctatggaactctgtagttacagattttgtgtgtatcaagctgcctttctattgtcaaaaataaccttttcggtttgtaccgtgctttccagttcacaaaccttgtcacatgcacaatctaattttatcatcaaaccaaacctacaaggtttaattctatgttaaaaattatgaaactgaggaccatagaaaatgaccccaggaaaatgtcaatctttacataaactatagagaaatgaatgaatgtggcaaatcctttaaaaatagagctaatgggatatttttatagttagttatggaagatgcataatacagcatctttgtcattgccatggacagaaaaattgaattagggctagtctatagaagttgttattgtagaacgaagttattaattctccaagtagtttgttatgtttaagtttcatacagctaaaataaatttttttagaaaggcatttccttttctttctatttttttttctttctagttgtttcatccttggtgtagctctggattaagtaatcaaattgtgaatattctgtatgctgatattaagtacattgtttaataatgtagttttatgttaaaaaaaaaggctcttccctttagtgggtcatgagatatggacaggggtgaagagagctggacctttgaaatgagagaagctcttattaataaagagtagattccagttatacagtgacagatgggacccaaggacgtccagaagtttgtgaaggacattgtcaatgtcataattgcaggaatacatctcagtttccctaggcttttgtaatcagtggtgtgctacatgtaaatcacatctatttcacagagttgttggtcttgaggaagagtttgggaagtaactgtgaaagaggaattgaactcatatttacagacctcctacaatgtgcttggaactgtggcaagatttttctgagtgttatcccatttactttccacaaaagtattgagaggaagtactaagctctttttggagatgagaggatgtcactgacccttaaagtggttaagtaccttgatcaagggacaaagctggcagattaaagattcagacccaggtgactccaaagcctactttttctttcctttacagcccttgtggtgacatgaatgaactttcttaattaagattgctgattcgtttatattttctaacgtgcatcataacctagctgtttactgtagttaagtcttttattttttttttcttatggagtttcgctgtcgcccaggctgaagtggtgcagtgatgcaatctcagttcactgcaacctccgccttccgggttcaagtgattctcctgcctcactcagcctcttgagtagctgggactacaggtgagtgccaccatgcctggctaatctttgtatttttagtaaagatgggttttcaccatattggtcaggctgatcttgagctcctgacctcaagtgacctgtccgcttcagcctcccaaagtgctgggattaccggcgtgagccatggcgcccggcctagtcttaattttatattaagcaagcaggattaacttccctaattctggaagtcagacggttgagttgtagaaagatgctttatgaatctttatatgaatcttccttctgctgttaggtttagtagagcaacccccttaatatcactatttctggcgctttgattagttgcttgttggaattgtcaaaatatctaaaaattttaataaaatagaaccttaaagggagaaaaatcacaccgtgagcccaagagaactccaaacactcaccaacatggggaccaaggcacctgattattatgtattgaggtaccattaagacctgcagtattagtttcaaatgaaaacaaaatgagacaagatatgtgcacagcttttatgacaaatttataatattgaagacaaattaatttaggtaccattttacagtatttgtgccagaaagaaaattacgagagctgggagaacctaggaaaagccaataagaactgaaaagggaaattttcatgattgggtttttaaaaattagaaatataagttcaacacatacacccaccttttgccttatagttgtaaacatttttgactacaaaggaaaatatatttgcaatgtcaagtttgctacctcagtgagaataacttattgagattcaaatgtgggatcccaaagtaattttagatttgaatgattttcatcgtggatactttttagtttgcttcttgcacttcagcagaattttcctcacaattttggcttaagtttccatctccaggacataatcttgcaggatcacctctcacccttatctcttggtgactgggtactgagatgggacattatgaacttgatctgacaatttaataagatgtaataagacctgaaatagaggcaatgccctttcaactgagaagatctagataggtacagaaacttttcaagggtatgtctaactaaattcccgttaagaattctctttgaaacattaaatgtcttttcctgtttgaaactagaatgtgatcagttggaatattggcaaagaacaggtcattagtgaaaactccaatgaagacaattggctttgggtttgattttcctgtttttgcagttagcttagcaccagatggtgccctagtgagttctgtataaataatacaatcatagggttgagtgattttctaccagtcacagactgaagcagaaaatagcacttgtctttccacacaagctcatgtagattcttttactgctgaattgttcttatgcagctctaacccttaaattgttattatggttgggtttttttctgtttctttattgggcaggcaagcagccaaatcctcactctgacctagagggaagggctgctggatttgaggatctttagctgatacatacatcccttgcagaaagaagaggcaaagaagtaaaactccctgaattctctctattgttcctggaaaaaaaaaaaaaaaaggagtggccctacacattcccttgacagttggtgaacattagggggtgatggaactggctttgcttacagaaattctgtgacaacctcttacaggctttcaaggttcacctcaagagccaactccagcccacaatgctcaatgatctctctctgggttcatatgacagttgtattttgtacctcaagatcaagctcttcattgcactgtatggtgttataccttccccactcttttttctttggatgtaagtcttgtcttacctacaacattgtaagttgctctgatctatttgcttacaacctgcactgcttaacacagaattgggtatttaataactatttgttggcatatgtgggtcacagttctcaaacatttgagcagagttttaatggtcagtatcctactgaaagaacagagttcatatattgtgacataaaagattctagtttcttgaaaaagaaaaaataaaaagcctttgctgctcttccctttctctttactctcccgaagatttgacccatgtagtagcgaaccacagaaaacatgatgtagcatatcgggagcaatgggcagaatcactaagaatctttcttcttttgagaagagcctctgtttttactttggaagcacaagtactcatacaatatgtccaaccttcactaaaattggcccactccattgtctttctaagcaaacatggggctccatttccaagtgactgttatttcctatgtgttagatgtttggggtgacctcaaaaaagtcattagtgtattcagaacaagttattcaaactggtaatttattaatcatatccaaatgacccatttcacatattccccaaagtattttatggtcttctgcagggttcccaaagtgtttcctgtggaatatcagtattccatgagatatgaatagatgcctcttggaaaaaaaaattggttgttttgttgtttggagaaatgttagactctctgtttgcctcttggggcaacacactgcatgttaaaggctctgaggattcctgcagcaaaaatatctggttaatttgtttaacttggcatttagcaaacatatttgaccttagaaagagaatatctagtgagtattctgtgccaggcgtacattaacttattgaatctctatgctaagactctaaattaggtaccattacctggatttaaagatgagggattgagaatctgctatatttaaggactttttctaggtcatacagtgacagagtcttgtatagtgagttcttatgttgcctctgccaccagctagctatgtgctaccattttgggccaacaggtcaatcttaatttccttatctgtgagtcacagttaaacaataaggttgctttgaagatgaaacttagttgaatttatattatagtattttggttaaaaaagtggtgtataagtagcatttctactttacaaaatcaggaggagaaggaggggaaaaacatcatcctataagaaacaacatattcactcaacatattcactcaaaacacataatgctaactgctagacttttaagaacgaaagcaagcaaacaaaaacgtagttttagctgtgcagaatagtgaccagaacatgtacattttcatttataagtattatatatttttggtatagtcagactctgcatctcatgtaccgatcaaattgggtagtacaacattaaggcacccaatggtattgtgaaattttaagactagaaatacattatgactagatattggagctttgatccttaactacaactttccttgcttctatggctttaagccagaagctgagcttctttgatttttcttttgtatcgtccattttaggtagacactacataaaccacttgtggctctgcctcactccaccaattccacaatgtggtatctgattgttaggactccactgtctctcccaacttgtcaaattcaccatatgaggtaaattcatttctacttggcactttacaatcttaatgtttaatgatgtagataataaatttccccctaatttttgattattctgcttgtgaaatctagatatacatacacatacatacatacacacataacacaatagagattctgcacatcagcttgaatgtggagatgggtttataacaaaggggaagaggacttctaattaaatgtctaccttgccaaattggaaactgatttccttgttacccaagttgaactgaatcctgttttcaatctagaagtaattaccaaggcagtacacaattgtactgaggcagactgcattttgcattctgcatccctgaactgtcattagctgatatcataaatattgatatatagtataatactccaccaagtttattaaaaggataatttagaagtccatagtggttttatcatccagggttctgccattctcagaagtgtgatgagtgtttccgtggttttcctagattttgtatttatgagttgtttatggctctgacattattttatgtcagaattcattaacctttaaaaagtttctgatatggtaaggccttattgtcacctctgctttctagacacacagaatgcatcccaagaagaggagatggaaccgatagcattcagtttactggaagctgctttctttggccacttggtttctgaggtgtagtgctggatgtgctgtagagggcagaactgcctgtgatgtgatgacattccatttcctttattgcagccccaaattacaaggtccattctctgataactatgatttcttgaaaggtgtgcatccatctctttactgtaaagaatagaagagaaatagtgccactgtttaaagaatggtttcatacgtaagaaaggataattgccacggaatctgtgcatagcctgaaagagtttatactctgacaaaagcatttctttaatggcaactccctgggtggattaatgcttctgtctgggttcttctcaacagagcttaaggggctgaatgggatagacaatacaaaaaaacccaaacagacaaactagcaaaaacctcccccattccttttaaaaccttttgctcttgtgcagctgaaaaagtgaagcaactattagaaatacctcttaacacttattaaatactgagccttctactgctaagcagtgacttaggaagtaatgaagctgaagctagacctactttaatattgattctggcctgaaataaacgtttatgtccttgaaataatttgttggtggttgtttattcattattttctttatatattaaatgggaagtcctttggtctccttcaagttctggatgggctaattagccattttgtaaaccaatatagtaccgtatttcgtctggataaattaatttatagtcttacattgaaatgtaattaaaatgttgttgcaactagtttttagtccctaatcagcagttgctgttaccctgtacacgaattggatggtaaattttattagccctttttcctgggcaaaagatagtgtctaatcacagtctgatccacagagctgcagaacaagcccgcaacttaagcttgctaagcaaaagttttccatgccccattattaaagatatagggagaaagatgtttttctttttgctttgatattatgttttgcattttcttgttgttgtctttatgcttgacagttcctaccttatgaacttgaaaagaaataacgccattttttgttggaatttaagccaatattcacttattttgttcttccaatataaatgccaactacaaacgcaatcaatccatcagtttgtctgacaatgctatttaaaagtaaatttcagcattgaagcttcattcattaatttattctcccactcaacaaatatttatgtatgctgaccctgttcaaggtattgtgctaaatagatcctatggagttttttgaggacatagcaaaacacgacccttttatttatttatttatttttgagatggagtcttgctctgtcgcccaggctggagtgcagtagcactatctcagctcactgcaagctccgcctcccaggttcacaccattctcctgcctcagcctcctgagtagctgggagtacaggcgcccaccaccatgcccggctaatttttttgtatttttagtagagacagggtttcaccgtgttagccaggatggtctcgatctcctgacctcgtgatctgcctgcctccgcctcccaaagtgctgggattacaggcgtgagccaccgcgcccggccgacactttcttaagtttaaaatttgacgttagtcaagttaaaattttaacataccagatttttagccaaaggaggccaagttgatgacagaaggtatatcagtaggcgtagtgtattgtcacaactatagtagtaacaatgtgaagacagcaacaatatttgctgaattagtgacttaactggaaatttaaattgcttgactctcagccctttaaaataacacggacagagttttttgtaacgatctgtgcaatcatgtaactcacattgctaagcatgttttcttcagaaggcacattatctcaggatcaaaataaggaatattgtatcatatttgtgtcacagacctcaattttaacacatttagtaaattaaatggaaggaactaaaaatcagtggggctttgatttgtgagaaatgtatttagaatttttggtaacagctgtttgcaccttaggtgagatgtactaaaatgctttgtgttgctttacaacattgcttgaatttgcagaaataaaattttgtgactatttctgcatgtacatacatactcacatacacacatgcacctcagttgaaaaaaagattggtgctactcagaatcgatagagacaatatagttaatgaatctatgtctaattcaaagtgtatcttgctgattagttaggggataggccaacaaaattctttgcgctgtgaactaatgtatattatcctgaaaggggttaaaaaaaaaggagcagaaaacaacttcttttcacctaaacttgttctcaggcgagaggtcacaaccatcactcagtaccagaaacctggtcttcagtagttagggtcaaatgggtagccaaccttctaacatgagggtagggtggtggtggttggtgagtctggaagctgaacagccctggaggacaaggctgcactgttacatggcagctcagcacacacaacagagttccactctttatcttctttgtgttaacaggctcttgtttacacattgctatttctgacaccttttcaacaaaagattaaggtagttgaaaaatcagcccttttgaagcatgcactcattggaggaaaagttttttttttttttaaatcattactctgctactagtatttctctagagtttctctcatcagaaactctggtccaggtgtcatggggaattaggattgtttgttaggtctggataaccaagtattacagacttcgagggtaggaggaaaccttatggtcatttagaccaacactcatctgatgtttggatctcttctgtttttaaaaagagtcccacttacagagaactgcctcctgagacagcccttgttcagtgttttctcaagagtgttctctttaacaccagcctcaagaggtactacaaaaagaagtgttccatgttcaaataactttgagaagcaatagtcaccatatcgactttgagtattcctgtagaaaataaacctgtttatatcaacttggagtatcccccaacttatttggtcatggaaactctttctccaagaaaacatgctttagtatttcattccacagaaaactcactgtagtatgtgtttttttccagataatacatatttattaaagcaaattaaaattgcattggctttttggattcatataaaactgacctttgacttcttgagtcttattttttagcacaacttgctgtttagccacatcagcatgttttgtttggcttgactttttggtcttaagtattggtcttcgtttttacattttgtcttgttggaaccaccctacctctccagcttggctttttggatccaggctaagtcatcttgtacattcttcagcagtctgagatctgtactattcactgatgtcataagcatactctcttcatctttattcattttgttgattggaaatgatgagcaggactggacaaggttggtatcactctataaaccatcacccattgattctgactgttaatctcccaaattagtaaaaaatttttcagaagagagtttccaataatccatgcctctagcctttgtggtttgcaaacctttttttcaagagccaaatcatgtttccctatttttagctctccaatttttttctgaggagaaactggtaataatatggtttctaaatatagtggctcatcagctcttcataaaaccaatgccatctcttttgaagaagtaatgttggtcaaaatcctgcctcatattttgcagaatatgtttttggaatatcttaaaacatccatggtgtctttctgtgcatagataatttagtttgtatggtttcggtatatttgcgtttgtattgtaattttctgtctgaaggaatagtttcttgaagttgtatacgctaattagtatagtttgtaaaataatagatacttttaaatgtgtgggaggcacagctttcaaatgaagtatttaaatataattgctgtttaaacgtttaacttaaaagatgtgtattaattaatttttctataactaactgcaggtttagggtggcttattgttaattaatctctgcacaaagcaaaaaaaaatccaatctgttgcccaaacttacctgagacatcctattttaaatgtactttatttatatttatgcaagtatgtttgcaaaggtttagccccaactacttattaacactaaattggatcctggagaagatttttttgctttgtttgcaaatccctagtgtagtattactgagattttgaatctacttttcaatatcagagcatctttaaatgttcattgttaaggtcaacttacaaaggagtgtgtcagaagcactagagagctcaagttctgagactgaaaagacctgagttcatgattgacaccatgccattttctagctgagtcactttgaataagttattttatgtgtctaaatatcagttcctcatttgtaagatgaaaaaaggatgatgatggatacctacctcataggattgctttaaagattacatgaagtgtattcaagtgaagcacttatcacattgccttacacacattaaaaactggataagtgattcttaagctcttaagttttatctataagaaaaacccttaaaatgtccacgaaaagttggcatgttaaaaatgagactttaatttgcacaaggttctgacaatcaaaataatcatatttctcagaagtcttctattttcatgatgatgatggattatatcacctgacttatacaacacggtagcatatttgaaattcagaccatttcagaaaatctgtttcacacagtcaccacatcaatagaacccaaaacatatctcaatcataacaccacattgggctgaaatgcatcttgtaagtaggacaagtagggtaataggatctactgctcttgctaggccaagatgtggtccagacagtcagtcagaaaacaaacaaataaaaacaaaataatggtcccttcccattggatacttaactcgcctgaatttgtcaaagtggcagtgggcttctttaagataatttatgtttaggacatggctctggacattttgtttccctatcaaaggcagctaatttgattaaaattttgtctggatatttttcatttcttaggtacagcctaagttacagaaatacatgtaccatggctctgagtgaaatatctttgggtggagtagacccctatttaatattaaaagtatgatgagatttaattatcaccagtcctgtaaggattcagaggatgagaccagccaacagcccaagtcctctgaagagacagcctcagagaacaaattcaatagatgatatcagacagtcagcagggcctcagggacgctggtacaaattactttctgcacaaggaggccctgctgagggggacgtgaatttgaactgtaacatagcctgcattcaactcacagtgggccctttatagttgttcagcctgaaggtggcaccttgtggtaattcttccacgcagaggaagagtcttattgtattttaaacaaaggtgcttcacaatgagtgcagacctggcaatcagtttccattcagactttggctctgctcccatgtgtcttataactgtatatgaagggacaagaccctttaatagagaatttgccctgttttaggagctaaatgacttggtccctcccagaacaatgcttttctttctataatatttcttgaaatgataatttagtaaggtaaatgataccttaacagtacaataaaaaaagaactgggactttgtagtcagaaagccataaagccctggattttctttctaatttcagtatctccaggctttgtgaccttgatcaagttaatggaaaatggggcatgtataaataaatcagattgactctctataacattttaaatggtcatatatacgctgtaaatgttattaaatttcaatgaaatttggtacatgagtagaaagaaatgaatgatttatgagacaaagaaatgactctctttgctattttaaagcagaatcatcatcctatctataatatttaccttaggtgaaaatcacctctggtgcacgttgactgatagaatatatgtatgatactttacatttatgtgaattcaggaattcagagaaccatttcttatataatggctgcctctgggacttagaggaagtgactctttgtgctgtaatctggccctttggggtttgagctgcagagaggagaggacccatgccgctatgttttgaatattttgagatttgagagcagcaaaccagatcacagaaatcagctggtgctaggtccactgagctaatcttacaaacatttcagaaattgacaggtggcctacaataatcctattctgctaataaagtttttttctttaatttctctagtagaattagttctgtagagaagtgcccattccatacagaatacacttatcagcaataatattacaaggttgttattcacacaggaatgggaaaagcaactggaagttctagtagctttgttgctacattaatagattctgctgtcaggcataagttgttctgcaggaatactaaaaagtaacctaagaataaatagctacaaaatcaagttccaataatatccttataattattactagctccaggattgtggagaaaagcctactggaaaacgcttaccattcatcgaaatatttttagtaaacaacactgaatcataaagaatgttctgtgtgttggttgctaattgtttttataaattgatctgtgattcacttacttaattctgttccatatctgttccttattattttctggtaggagttggttcagaacccatattaatttatgatttctctggttcacaaattcctactttactcacattagaccatagaattaagctccatccccaaattgttttttctatcatctacattttttgatatcacatctactgttgcattttacttccctaaaatgcattgtttttcatatgactccttttaatgtgtctttgattttttaaattgttgtttccattggtgacatttttgagagtaatgttaaattagttctacaacttcttttggctgctataaagtctacaaaactggaagtgtaaagtagtatcagaaagaatgataatcttataatgcataaaatacttaatcaagtttaacagaacctttcccaatcctttttttgattgaatagcttacttctgttgggatccttagattgacaagctgattaggaaggaaatgtgtttggtagattctttgagttgtcacattctagacagtttcattttgatgtgtgctttaattaaaataaatttatatacaagggtgcggcataattttagcagttggtagagatttttggaagcttcttttttctattttcctaagggtatttttctattcaaaacatcgcattggcagatagtggtgtgaatttatcccaagctttatgaaaccaatcttttttttttttttttttttttttttgagacagagtttcactctcgttgcccaggctggagtgcaatggcgtgatctcggctcactgcaacctccacctcctgggttcaaacgattctcctgcctcagcctcccaagtagctgggattacaggcatgcaccaccacgcctggctaattttgtatttttagtagagacggggtttcactatgttggccaggatggtctctatctcttgacctcatgatccacccacctcggcctcccaaagtgctgggattacaggtgtgagccaccatgcccggcctctcctaggtttatgtgttgggttacctagctgataaattgggatcttataaacttatattgtgaatgcacactgggctagtccccttacctgtgaaatggctttcttggttttatgtctacctgagggcaggtgttttgccatctgttcttatacccccatgaatcagctctctggactccctggtggtatttgcttaacacactcaacctacctggtttcctgttagttggctatgctgcaatttgaggtgtccaaatgtagtggaaccctcagcatttcttttaaaagacagtctttttattcctccacagtcagctttgtttctcattccacccaatagccatctccagctgtgtcttcttccttcaaattagatgattaggttctccaaatctcatcatgaaaatggaagtcatcaagcatgaactccctcaactttgctcatcctcgtctttaaaatgttatcaagcttttttttttctcttttcctcctgtctttgagtaacaggcgtgttttaccaatatgttttcatcttttttttctttctactttcttgttgcaggtcccttaactcaggctgtcatcatctgtcattttctaactatgattgtctctagtcttctccactaacttgccagtccatgctccacaacatagcaaaaatgattcaccactcaaatcatgttactgagttgctttcaactcttctttgcctgcaaattaaaatctaaaatatgtaacatagcgaacaaagtccttcctaatctgaagtgttataatgtaattttcccccattccccttgatgcagtcatagtcactgttttctggtcataccatgcacatttatatcctggtcccttggtctatgcaagtatttgtgttccctttcctaaaatatcttacccaccttctggacagggtgagtttctactcatcctgcaagacttacttgaaatattgcctccatatgacaccttttccagtccacccctaggcagcattaagtcctacatattttcatggctgtgtttgcatgctttctttttgagacagagtcttgctctgtcacccagcctggagtgcaagggtgcaatcatggctcactgcagcctctaactcctgggctcaagtgatcctcccacctcagcctcctaaatagctgtgtctacaggagtgtaccaccatgtctggctatttttttttttttttgtatattttgtagagccagggttttggcatgtttcccagactggtctcgaactcctggcctcaagcgatgcacgtgtctcagcctcccaaagtgctgcgattatgggcgtgagccaccgtatctggcctttgcatacttttattacagcatctccacattgccttgcaattatctgtttgtgtgcctttctgtccttaatagcctggtgaacatcatgccttagtcatctttgtttctcaagcttctagcatagtgcctgacatacagtggaaagtccctacatattattgaatgagcaaatggaagaatgacaagtaagcagctcgggtttcatttgaagcctccaattccagacacttgaaagaataaacaacattacaagaaaactggtgaaattaaagcaagagatggcatagataatgacaggtaattactggattgcaaaagtcacacactagctgaggcttttgtgtaatgtggggagtaggaggggcagggatacaaagagaaatagagtgagatagaatgagtagctgacaatgatggaacacttgacacacacagacaaacatacacagacccctaaattttctatctggcacctccttttatcctcttaagcatgaatataataagccagtagcttacatcttccccagaagtgccttcccaaagggccatgttcaccacttgactatgctcctaaatgtcattccctatgcttctccatggctgaaaccccacaaggaggttgattcaacttactcccttccccaactactgccattcttagtctcctcccacttggtattacagtatgccaaatatttttcttgagttctgtctcaaaaggctctaaatagatccagccaccaactaagagacatgacatgtttaaattatatgagcctttaaactaaatgtgttgaaaggctgccccatttattcatttatccacacattcaacaattagattatgagtacctactgtgtgccaaaccatacagtactgagaaatatgtttactatacccttaggggatgatatcttctcatatatcaactacaatgaggcattccttctgcttttcaattttaagcagttttttggaatttagttgaataaagctaggtgtccccaataaatagtcttaaacccagcaatcttaaaatgatctggctgtagataatgctaggaatttttaacaaaattgggtcttacaaaataattggttttaccaatgaatttgggaaaactataacagaggtatctttaaccgtaaaaatgaccccgaaaatttatcaacctctctgcagacctttataagagaccagcaccccagttgatctttttgaggtcctttgagctataagatcctatggctagaatttatgcttgatattgaagtttctgagacaaacctctatgcggctttatgatccctctttttggcatcccatttaggaaaatgaactaaagtaagtggtctttggggtaatttggaatacagtgagtcctttttacgtcactggtgatggggaacactaagattttatagtgtataggtatttttgaagctatgatttgactcaatatattttatttcctactgtcatgagttatgacatcgacttttcaaaatttgtataaatttaaggggaacacgtgcaatttttgttatggatatatcgcatagtagtgaagtctgggatttcagtgtaatcatcacccaaataccgtacattgtatctcacattgacttttagataaagtggatttgatgttcagaaaggcttatctgtttttgtctgtatactcattttgctccaacaggtcaatttccccccctttcttcactataactccttaatttttctcacctttttgttacttctttaaaaaaaattttaaaaaaattaataagctttatttgtaaatcaattttagattttcaaaaaattaagcagatggtacagagattaaccatcctccattccatggagtttcccctattattaacatcttgcattattttgatatatttgtcacaatgaaccacactcatacattattattacctaaagtccctgatttattcagatttccttagtttttacctactgtccattttctgttgcaggatcccatccaggataccacattacagttagttgttacgtatccttaggctattcttggctctgacattttctcagactttccttgtttttgatgactttggcagtactgattaggtgttttatgaaatatccctctgttggaatttgtcttgtttttcctatgattagattggggtttggatttttgaggggaagatcatagaagcatataaaatgccatttaattcaaatcaaatcaagggtaaatgttatcaacatgacctatcactgataatgctggccttagatcacctggtagagggaatgtttgtaagatttctccattgtaaagttactcctcccacccacctttctatactgtagtctttggaaggaagtcattatgtgcagcctatatacttaatgagaagggatattccacatccttgagggcacagtatctacacaaattatttggactgcttcacaggatatttgcctcatctccaccatttatttatttattcaatcatttatatatatcagtgtggacttacaaatatttattttttattttgggttataataatccaatactactttacttttttgtttctcgaattgttccagttttggtctttgggggctctttcacttgattcctgtgtcccttagacatacttccagcaatgtagggttttagtgttttatttgagcatttacttactttttgttacaacaggatgctctaggctcactttgtattttcacttctttgcttttaattttagttatcttaagagaagctgatagaagatcacagctgatcagacaaagcttattaatgagtctgaaaagcaatgtgacctcatatttttactcatctttcatctatgacttcagattgtagttaagaattattctcatgctttatattggttgtccccaaagtttagctgttttctatgcaagaaatctgcaatttgtgaccaatgattttcatagatttacaatgccttcagtggattttagatttactgaatcaacaatttgtatataaaatatatattttgtatataaaatattgataatattcactttttaaggaattgaaaagttttataggttatattctaatagtaacttaaagtaaagagaggcaattgacattgaaaatgataaataagacaatgattctgagaaaaaaacttaccagtttacatatcctgcctatctatacaaatattctattacttaaacataagtgacagtagagatgctcatgtattacagtattctctcttaaggtctgtcagcattttcattataaacctgcttttcaagggcatataatatctctaaaatttcatttgggatttaaacttgccaaacacaattgcagactaaaaattccttttgaatatttaatcagaatcattgtttttgtcccagtacttttgcttgtgtgatagcgactttctttcttcctgtgtcttgataaatggtttctctcccatctgagagtgatgactgttgaatgagaacatggccttaaattctctgagtttgatgggtagtgtgtaatatcataactctttgattctgcagcaggcaacttccagcagagaatatgttttctaagtggcaatgagtgtttcttattcttctttttttaatggcctattaatgtagtccctatgaattatactgtatttctctgttgatgtgccagcaataaccagttagaaattataaatgtaaagaaaacttaccgacaatatttttaaaataaataatctgtaaattttaggaattattccagcaagaaaaatgcaaggcttatattttcttgagaactaccaaatttttttcgagaaacataaagtagaatttgaataaatggagacatacaccatgttcttgactaggatgtctgaatattaaaaatatatgtttttttctgtttagttgattataggtttatagatacagtacattccaaattaattcctaggttttatataaattcaacaacaaattacctttacttttaaaatgattattctgaagttcattttggaagaataaacagattttaatagttaaaatgtttttaaaacatgaataagataataaaatgcatcaaagttatagtaattactagtgtggtaaaattttaagaatggagaggtgaataacatgaaccagatatccttgaaaaaatattatttttataaaacatcataagcaaaggggaaaataatcatttaataaataattcttggaaaaaatggctatttgggaggcaagtataaaccataaaatctcatgttagagttttactttacactcaacacctaaataatttttgaatcatttaagagttaaatattttaaaagtttaagaatagaaacaaatagaatttactatttaattcctttgatggtgagaaagtattttctaatcataagcatatagaaaaaaaatcacaaaagaaaaagatgctggatttcaattgacagcaaccaataatttttcctagtcagaaagcatcattatcagaatgaaaaggcaaatcacaaatagggaaaatatatgcaacatatataacaaaagcctaatgtctgtaatatataaatatctcttataaatcagtaagcaataatgaacacctctaaaggaaaatgacaaagatcagaataggaaatgaaatgaaatatacatggaaaataaacatttgaaaaatacaagttaaaagcagatttttggacaatcatattcacaaatattagaaataaattaagtttttgtgaaggtgttgtgagacaggcactctcacagttagacttctggaggagtgtaaattagtatcatctttctggaaagtaaatagcaatatgtacaaagagccttaaaaagctattaaactttaacccaagaatcttgtaactagaaaattaccaaggggaaatcatcaggatgtagacaaatattcatatgcaaggaaaatccttttcttattagtactaatgatgaaagactggaaaaaatctgaaagccaacaaaatgaaaacattacaaacattacagtacatcatttataatagaataatgggcaggtatttaaaaccatgtttgtatacatgatttcagttgtcatttgtgtaggtaacatttttttttttgccctgtatgtctccttcctgagcctgttcaagttaaaataaacgattggtagttgagtcaatgagagtttacaaaatttctaaaactctagagagtcactattccttggtttacagttggctcttttggcttgggtaggaatgatgcttttattgtaggcatcaaattacatgtgccacttacttagaggacctaaccctgaaaagacctcagaaactatgcctcagtaaagaactcagatttcactcccaagtaggcatataaaaaagttgaccattcacattctggaaattctctttctttgacttctgggttaatagtctctcctggttgttcaccatatttctaattagtcctctgctgtatccctagtatgatcggggaggtacaatgtagatttctcaaacaatcttttgccgttcaaaatggctgtgctttgggttaagacacctaacctatcattaagcagtatggtgagtctgtgatttggggtcagattccagcctggctaccagttagttggtgactttgggcaaataatgtaacctctctccttagttgttatggattaagaggtgaaatgtatatgaaccacttaattcattgcctgggatatagtaggcactgaaaatggtagctattattgttattatgatgatgtactagggactatggaagaccaatgaatttctacagaaaatactgatgtttttagaaaaaggtacattaataggtaatactactaaagcgacagaatatcagctgagctgccagtctaagtatataagacataaagaaaaaaaaatagttttcaggagacactctaagctagtggcaatgaggcaccatgctttatccacttatctatcccaaaaaccaagcacagttcccaggagatagtagtattcaataaagatttttttgaatggatggatggatggctggttgaggtgtgacaaatcaaagcccctggtagccagtgcataatatgaaggaatcctgtgcatgtgtgtcaggagaagagaggatataagtatggggaaaggggagggaaggctgaaacaaagagaaataaaagggtattgaaaagatctacctctcaactttttgagcaaaatccttcctgtcttctatattgtttgaaaccctgtttccacacacagctaaaacagctgagaacatattggaagaaaggaaacatcttgtggtctcacctacaaacttgagcatccccactttcacttccaccctcctagtaaaaattatgacaatatgtcaatatgataaggcagagactactcctgggagctgttcctaaagtctgtggggatccagaatctaggctaacagggcaataagaccatggctacagtgacctattttctgaaccctaaattgggacacacagtctgaccaaatatttattttcaatatgtggatatattcatgttaacaatttcaagagttgtatatattgtatctcctttaaatgagttactgttattgaaaataataacattctctgaaattagggctgttctaaaaagttggaagcatatcattaccatgttttttggcatctttcaatatatgtggggtttttttgactttcaaaaacttagtaatgtcacagattacagtaacatatgtgtgtgtatgatgtgtgtaaggtcaagatttcagagttcagaatcttgggtagagggatgaaaggatgcattcagcctcatgggtaatagaggagcagggaccaatagatgtggtgttaattagacttgagagataagggtacaaaatagaatctagaccccagaagctcaggaatataaactggactagaaggaggattaagcattcactggaatcaaagtacaataattatttatactatgtaaataagccataagtagatgcatttattcaataggaagctgaatttttgtggaaagactccaggagatgttgagcttaatgaaagaacaaaagtgtacatattcagttggcttcaaaacagaacagaattaagaagtttccaaggacaaaggtgatatccaccactattcattcagtcaacaaacatttcaatgtgccaacagtgtgccagatagttctagacaccagggatagagcagtaagcaagattgatcaagtcccctctttcatggaatttgcattgtaatcggaaagtaataaatgaataaaatataatttattgtacattttaaaataactacaagagtataattggattatttgtaacataaagaggagatgtttgaggtaatggacactccatttaccctgatatgattattatgcattgtatgactgtatcaaaatacctcatgtaccccatagatatatacaactactatgtacacacaaaatttaaaaagaagaaattaaaacatacatatatattgtgttaggttgggataaattccataaagataaacttagacaaggggacaaaaaatgatgtaatgcacctggatactattttagttagctatgattgtcagtggccttctctctgaggaggtgatacttaaacaaataaatgaatgaagtacaggagccagccatacaaaatctggagggaggaggatggcattccaaacagattgatgaataatcaactatgccctcaagtggtattaagcatgcactattagacaaaaacaaagccagccagtatggttggactttagcaataggagggaggcaggggccagtttgtatggggccctgtagatcaatgtgagaattcatcttattttaagtatgatggaatactgttggaggcttttgagcagaggaatcaggtgatctgattcatatgttgtagaaaaacaaccattgctgctagatcaaaagaggttttagagaggcaagaattcaaacagcaaggccagttaagaagttattgccatattctagttacatcctgatggtggtgtggacaagggtaggtggtaaagaatgagttttcacttacatttgcctttcatttatttattttttatttatataaacttaaggggtaatgaaattttggggcttgcatttttgttacatgcatagattatgtagtggtcaagtcatggcttttagggtgtccatcaccaaaataacataccttgtacccattaagtaatttctcattgtccactgcctttccacctccttgccccttttggagtccccagtgtttattactcccctctgtatttccatatctacacattgtttagctcccacttatgagcgagaacatgcaatatttgtctatgtctgtctcatttcactcaatataatgacctgtccggttccatccatattgctgcaaaaaacaagattccattttttatggctgaataaatattccgtagtgtgtatgtaccatgtttgcttcatcaaatcgtctgttgatggacacttaggttaattccctatgtttgctattgtgaattgtgctgcaataaacatacaagtgtaggtgtctttttctttttcattgggtagatacccagtagtgggattgctggctccaatggtagttctatttttagctcagaaagtaagtatttttaagctaaaaatctatataacttgctgattgagtctgtgtgagataggagggaaagaggaatcagggaatgcaccaagcttttttatcttagtaactgtgtaagcagtgatgccatttactgatgtgaaggtgtaagtgttgggaagatttgggagggaaattgaaagacagattttggacctattgaatttgagatgcctatactataaccaagtggaaattaagagaaacagctgtatacatgagtatgaagtttaggctatggtcaggattgaagttataatttaaaaagtggatacatggtattgaaactattggacaaaatacgacaatctagcaaatgaatgcagatagagaagaggcccgacaaacacacactccatataaattactctcactaagacttatttgttcagtcaacaaatatttttgagtgcttatatactaggtgttgttccaagatttggggatacagtggaaaaccacatagataaagctgctgtcctcacagggcttagaatgaaaagttacatgggtgataagaggaccaggacaaaagggtagcagagaaaaatagatgaaaacattgagctttgtaaagaacaaaacaagcctgacatttgctaagccagtatgtgcctgttaagccaataaaacagagaaaatgagtgtccagggtaagtatcggggatggggaagtaggaaatgataagagcccgggatacctccaggagtgtggttggatatttctggagtacacacaggcagaactgaagccttgagaggaatttttagccttttggaaaaatgtctttctcatctccagtagatacagaatagaagatattaacattgtgccagaaaagaaattctggagtcacaggtagacaaaagaccagaaaggcagtaaaaagttactagctcgggctccaaaagcaggaatatattattttatattttatattttcaggaatatatgattttatatttatatttaccacctttagctaagggacttaggtaatttacattttctgaatcctagtttccgcatctgtaaaatgaggagcaaaagtatgcaaagcacctaacaatatgtcttgtatatagtaaacactaaataaatgttagcttataatgatattgattctgattatagtaacaaaggttgagaatctccacagctgagctggtatgggtctccatgatgttcatatttcctcccaaaggaccaaggaaagaaatgaagttaatgaggcacataggcaagctgtgccattcaagaaacctttgatagatcatttttaacttaggacaggcattctatactttgaaaatatgtctggttttatacttattttattttttattaatttcaccctttcacttttcattgtttattggccttttcatatattccctctctgctaaaagggaggtgggatcgagaatctgaatttctaacaagcttccaggtgatgctgatgctggtgctgctttccaggaaccacatcttgagtaacatggagctaggaaacgtatctggaggacactagaaaacatatcagagctgcggcaatcagtgatctgattctcaaataaatgaggcaggataaccgtgattactcctgcttctcatttcagcctccagtggttctcttacattatatgcagcataaagagagaatttggaggcgagtaatggggttagaaaagcaggaatgctgctcatgattccttatagcctccatgttgtcctgaaacagatgtgagtgcacagctgtctactacaaagagagcttctgaggaaagcctccatggagcaatatatcttgcttttatcattttcctctttatgatgttttcttttctcaatcccatgaaaaatcacataatgggagtttactgtagcctgtttgaatggataggacaatggagaaataacgtagtcaagaaactgttcccacaactaaaagaagtttatctgagaaatgtttgtggcagaacataagcaatcattagaaatgaaatttgggaaagatgaaaaatcattcaatataaatcatatattgtttatcagaaatacttggaatatacagaaagattttcattatgattattgagataaaaatgtggctttcaaatatattcttccagtatgaccagtatattttattgcaaaattattccttcttcaagaaaggtcttttataaatggacaatgaaacaggctgtgtattcagatgctactgtctatcctcagatatcttgcttttcagcaagtaaagcagaaattgatggtgacagtcttcctggatttgttggctctttcaccatgatccactctctttataaatgaaacattgagtttcatttggtgattttagatgcatttattatttttatatcttattcagtcttgcattgctatttaagttcatttagttttcatccacagccctttagatgttttgtctgtacttgattgattgatatgagaggcagtattgtgaggtatttcaaagcatgagctttagaaacatatttgaatcctgacggtgctccttattacctgtgtaactctggagaacttgcgtaagctcctggtgtcagtttattcgtctgtgaaatgggaataataatagttcttacagggttgttatgggttacaaatgagttaatatgcataaagcagccaaaactgtgaccagcataactgcaaactcttactaagcattcagaatatattggctaattgtattaatgatgttttatgtaaaccatttcatgtcaatgctcatgttttatctccccagccagactacaaacacattttaggtatgcgagcaatacactttattttctgtgtatttccttcagtgcatttattatttctgtattgtttgccatcatcactatggatttagtttgaagatacaactaccaagggatgcattataaattttaataaatggaacctgcaattaagaaaaactgctaccaataagcagtaggtaatgaggtgaaataaatggaaagcatgtactttcttactaataattaatactaattataataacacctatttctcaagtacctattttactttgttagacactttatttcatctcttttattgttcacaataattatatgaattaggaaactgaaagtcataaaggtttagcaacaagtttcaggtcactcgggattcaaactgactgctcactaattgcaaacactgcattgccgcacttcttttttaaaaatttttgaaatataattcttggtaaaaataactgaattgggttcacataacagttctacttttcagtaaccatgtgacaacttggaattcataacccatatttgtgcagaaagacactgtgaatctaaatctaaagcttctttgtagaatacttcatcctctgccatttccctgccagactgctgctcctgcctccagaaccacatgacttgatcatttattccaaattctctagtcactgccaacccaagactgcacatcctctgttatcataccccagggtttgtcctccttttctgtgtaggtaagagttatgatcatgtagttctgattttccattcagtgagaataatccaaatatgaaaacattgtctttctccatctgtttcaacacttgggctagctatcacattttaattagtaagtagtactctgatgcagtggtccagaacagaaagaaaatgatcaatactgccattccaagtccagatgtactataataagcaccttggacataagtgggatgacttcagttgatttatagtcttagaattggcagattattaagccaccaataatctccttgttctcctttgtccaggatttccctcttctctcctgatcatttctaatttttcctgtccgtagggagtgcatattgggaggaggaagtggtaaaaggtaggagcagatgtggtgagaggtcaaagagcaggaggatctgtgaatgggttttcttagtcccaagcattcttaacatgagaatacgtttcaccctatattgattcagtcacctggaaaatatgtgtcttttttggttacagttccttcatcctctatttttagtccaatttgaatatcatttgcaaactaggaaatgtactctaaatcttcatccaaataattacattcatataaaaaatctgttaatgaaacattagagctaaggtcttaattcgcaaaaaaatcaacccatggagctcaaaaattcagttgagattccatggcaacaggatctattattaactgtatatatgttatctaataacattttgaaattaacctgctagtttaggttccttagtactatatataaggtaagatgctgtttaaaaataagataattttaaaaaataatttgtctggatgaaaattatggaaaacttccagttccttccgattattttattgcttatcaaattttatgctctttttttaatcagttaatgagaaacgtcttcattacttttgaaatacgatggcatttagtgtccaggagtcatatttctgtcatacattttccaaagaaaaaaagtagcagaaagggaaaattaaaacacaaacttaatgaagtaggaaatgctaagaagggaatctgagagagcagatcatcctttgagggaaggaatctggatgaaaaaaaaaattttgaaatgtttaagtatgataaggataacaaaggcatctcaagttgagtaaaaggtattataccctaaaacacaaaaggggaaaactaattcaagttaacaaaaatgaggaagatggtaagagtttttagtaggcacattgttaatatcaaggtaaaaaagattgaatattgaaactagtggatgttaaactgagagcgtctagtaaacatatagagaagatgattcaagagtggcaagtaatgctgagatattctaatccaaacactgcctatgctatagatggcaaaacagaggcccagggccgagctgcaattttaccaaatgcacacagcacaatagtagcagcctcagcacacaaaaatgccagactccactctcccagagcaagaacccatcatcacgagagatccttttcatgatgatgatattcaaacactggaggaagcatttactagaaacatgctgtttattcatcactgtgttggttaacacatgggacccaaaacaggaagccatgatatttaccatgaaaagttttttatcagtttgggaagacaatacataatatatttacattaatatctacagagcaaattcaagttcaggtaaaacataaagatctaaaagactacatggtgcagaccatacacacgtttctggcatgattccaagtaaaggagagatctgttagggtatgatgtgactttacaatgtgatgaagcttcaactgctggtgctatattgactctaaaaggaaaaagctaaacattgacctttgtaagagtagagatttaggttaatcataaggaataactttttactgattataaaacatatagaaatcttactttttctatagtagtttttggatttaggaagaagtcaaaggaaatataccatgcactccttactcttcagtagcttatggtttatttgtagagagaagatattcattttgaggtgtaagatatagataaggaagtttatgattatgtgacaaaaggaagacacatgggaaatcaaatgagaattctagaatgatctcagagaagaggaactctgaggattagtggcagcatggtgatgtggaaatactgtaagccattatgtcaaacaaattgggttaaaatgcaggctctgatacttactaggtttatggatttgctgagcctatgtttcttttcctgaaaaactagggatgtaatacctaacttgtagggttcctatgaagagtgtcaacaatggatgaaaggatatggggcttcttttggggatagggaaaatgtttgaaaattgatcatggtaaaggttgcacaactctgaatatactaaaatctaccaaattgtacattttaaatgagtggcttttaaggttatattctgtgcctaagtatatatacaagagtaatgaaaacatatgtctacataaaaacttatgcccaaatgttcataatagtattattcctaatagccaaaaagtggctataccccaaatgttcatcaactgatggacggataaacaaaatataatatatccatacaatggaatattattcagccataaaacggaatgaagttttgatacatgctacaacatggatgaatctcaaaaacattatgctaagtaaaataaagcacatgcaaaatagattgtgcaaacctattgtacaatctcattcatgtcaaatattatgaaaatacaaacctatagagatagaaaatagattagtggttgccaagggtggggtatggtaacaggtagtgattgcaaatggccacaggggacacagggagtgttttggagatggtgtaaatatccaatgtaaatatcctaaagctggtttgtgctgatagttgcacaattctatcaattaactaaaaataattgaattatatgtttaagtgggttggttatatttcaataaagctgtaatggattcaaagtgttaagtaataaatgctcaactaacagtagcttttttgttgtttaagtaatcaggaaaagcctcctgaaggaactggagttttaatgatgagtgacagatagctttgcctagatgatagggaagtgggaaagtgaagaagaaataataggaaaatagtatgggcagtggcctggagagagaatagacctggtgtaatttgtcttactatagagctgactagactaggaagttagtactagggaatattgggatagttgagagataagaagctgttggaatcagacctaagactgggaaaggactggtaggatgtgcctcacatgtaccattgatgagtgggtagaaatgaagagattcaagtgatagaggccccagatgatagagatagttaagatatggcttttgtcgaggagcagtgggcttcctgggtgctagaaatagaattattctggctgcagctggctggtactgatccaaaccatttagaggctgagctggggaagattgtagatggtaggatatggtgtggtatggtgtggtgtgatatggtaggtgcctaagcagtaacttgtgtctgggcaagtaggttagaagggccagcctggggaagcagacccagagtggccaacctgggagtcgaaagggtaaaggtgatatggtggacccatctaggttaaaaaaaaaaaagaaagaaaaataaaagtgatccagctggttatcttttctctggctgctcttggagtcatgtgagaactgactaaactgtcttccagtcttgtgagttatttaagtaagcagctctgtcaagattatgccctccagctttccaacaaatctagtgaggtcactgggggagaaatctccaaatgtcttctcaaagttgtatagaattttaaagatttcccgcccaacttgaggcaaatccttacagtgcttaatctcagtgatgtgataagatcatgactttttcagaaatgtctttgatgtcaatcctaattctgctaaattttacctgacaaggaaagaatgaaacattataagctagtttgtcaagcatctcagtaatctgttttggcaataatctgttccagttcagccctgcaatgatggggtctggtgaatgatgtaccttgacttggaaggaacttattaagtgttcaatcattgattaatgaagtaaaaatgcactaggtagaccttgaagtgaaaaactggacaggaaccttggcagacattagggcctcctgcacactatccatactgtgatttattttgaaaatgatgactactcctttttttacccacatacctacaatgccacagaaagaccagtgttgacaatcaacagatacagaaatgaaaaatactgcaggtgactcctactttgagttttaatcaccattataaaagtgaaaaaaccataaaggattagagttgtgaaagcccatttttcctcaaatggcctttctgatgtgtaaattttaaaaactatgctatcatttttgataatataaacataaaagatcaaggaaattgaaattgcagttttattttttgagatacattttatgattggtcataacagcaaagtaagtaagtgatatttttcagttgatcacccattacgttttagaatgttttaaatcccttcatcatcaatgtatcccgcgtccccaaagaccacagacactacacctcacaaactgaagaaatttggttagttttgcattttcttcatattgcttgcttttcttaattttttcataagttatcgggttctttctgctaaaatttacctccatgcctacatagattattgagttcttagaggattaataacatacaacatacaaattttcctgccctctgcttttgtgcctcaatgtgatgcaaaaggtttgatctcatatatttgatatttgtgtagactagcagctcatgagtccctattgaggcatgtctatcatgagtaactttttttaattctctgggttaaattttaaattttctttgaactttctttttagagataatctctcaatgtaattataaggcaaatgaccaaaacttcctcctttaacataaaaaagaccttacataatattattatgtgaatgtagcgtaagagcataagatttagtaatgtataaaaccaaggtgacatggcagattccatcagatctgaaaggtttaccagtgctgccttgcaatttcttttttttattttattattattatactttaagttttagggtacatgtgcacaacgtgcaggtttgttacatatgtatacatgtgccatgttggtgtgcaatttctttcccaagcttctgaagatttcttgttcattacacccctcaaaactttgagtattatagtcccaaaccttgcctaatgacacttcctgtgtggacaattcatttaccaagaattgcagttttttaaaaaatgaagtgagaagttattagtttaataacacaaggtaactcttcatgtcttggtgcccaataggcactcttataaattaccgacaaattacagtagatggcaattcctgcactgctgccactgatagataaatctatgccatattattctggcttttattgactcttaaaacagcatcagattgattttagagtagcaaggatataaaataaatacacaagatacctttccaataaaggaaaggaaaaccagacttctttgtgtctgagaattctagtgttgaaatggaagaacatttctgagtaccttcttgtttcagcatgaaaattgtttcctacttgactttaaataatgcagagctagttttttgtagaagaaaaaaaatcacaggactgagaaaaaggaaacccgatattttagtccatcctgtctctgtcactaacaagctgtatgaccttaaataagtcatttaagtttcctgtgccttggttcccacctctgtaaaattatataattgaatttgatgaccttcgacactgcttttggttttaatatcttatagtttattaatatgaatgcaaatagtaccatatgcattatatttatacttatatattttatttatatgatctgacagaaatatatgaatatagagtttgaaactttttgaagacaaaaaagaaatggctactgaaacaggctaataataataactaatatgtgtctattattaatcaattcaacaaacatttataaacacctaggtgccctatcactggtaggtatagagaggtgaaaatgaaatattccctttttctttatacataatagtgaaggacgtggatcttaaatatagaaaagtcttgatttactaaaatatttagggaaggggatgttaattgaggctttttaaaattaagtagcacatctatcttttatttcagtctttgtggttgaaacgtttcatgtaactgtagtccattttactactttaataagtacagttaagtgaacataattgcattttactttattatttggaacattttttcagagtctcaagttcatcattctgaaatctgttcttattgtacgggaaaagtaggagattgggatgaatctctattgacctcagactacttcttgggagatgaatttatttttccttcagtaaattcaacataaaggcttgcttagtcaccatgtctgtttttctcataaaaatgagtgtagaacatgaaataaaatgtttcattagttggacttcagttaattaaggttttactgtacataaaatcctaattactaacagagagatctggtcgcttttgtgggaaatagtatgttcagttttgggtgtgaaatttggttaggaacatagctggctacatgacagtatccagaagatctcaaccagaaaggtgaaattagagcatgtaacatgcaaaatggtaaaaggaaggcaaattggggtgaagaaataaattaaaaagaggatatatccatcttctttctgtttgaagagctgatttgtagaagagtgagtagaatgtccagtctggaaggaacccaaaaggttatctgttctaaccccttctcttatacatctgttcatgtagtatttgatttccttctacatcattctgttaggtgactaggaacatctggagaacttcaaaagcaaccatttcatccatgattgcccctgttagttcttcttcatattgagctcaaatctgtccacccaccagtttgaggaacacagaatacatctatttcccttccacattacagtcctttagatatttgagaacatctaattttacagaggtgggaaccaaggcacaggaaacttaatgacttatttaaggtcatacggcttgatagtgacagagacagacaaacatgtcctccttggatctaatttttactcccctgaaccttaacaagtaaacttgttctccagaaagtgaagttagtaccaagatcactctcctgcttaaaaactactgttggagtaaacagcctacagaatggtagaaaatattcgcaaactgtgcatccaacgaaggtctaatatccaaaatctacaaggaactcaaacaacaaggaaaaaacaaacaactccattaaaaaatgggcagtgggcataaacagacatttctcaaaagaaaacatgcaagtggccaacaaacataagaaaaaatgctcaccatcactaatcatcagagaaatgccaatcaaaaacacagtgaaataccatctaacactagtcagaatggctattattattattattattattattacttggacacggggtctctgtctcccagcttagagggaagtggcgtgatcctggcccactacagcctcgaatttttaagctcaagtgatcctccctcctcagcctactgagtagctaagaccacaggtgcacaccaccatgcccagctaatttttaaaatttttttgtagagacaggatgtcactatgtcacccaggctggtctcgaactcctggcctcaagtgctgggagtataggcatgggctaccaggccaatctggctattactaaaaagtaaaaaaacaataggcattgatgtggatgcagagaaaagggtatattggtgagagtgtaaatttgttcagcccctgtggaaggcagtatggagatttgtcaaaaaactaaaagtagaactatcattatttttataattttttaaatttttattttattttaagttctgggatacatgtgcaggatgtgaaggtttgtaacacaggtaaacatgtgccatggtggtttgctgcacctatcaacccatcatctaggttttaagccctgcatgcattagctatttatcctgatgctctccctcccctgtattcccagcccccaacaggccccggagtgtgttgtttctctccttgtgtccatatggtttcattagaactatcatttgatccagcagtcccactactgggtatctacccaaaggaaaaggaatcattacatcaaaaatacacctgtatttatcagtttattgcagcactattcaccgtagcaaagtcatggaatcaacctaaagaaaatctacaaagaatttacaaagaaaatgtggtagatatataccatggaataccatgcatccatagaaagaaagaaatcatgtcctttgtagcaacatggatggagctagaggccattatcctaagtgaaataactcagaaaaggaaaattactgcctgctctcacttacaaatggagctaaataatgtgtacacatgaatataaagatggaaacaatagatattggggactccaaaattggggaggatgagagggcggtgagtgttaaagaaattgcctgttgggtacaatgttcattatttgggtgatggatgcactagaagctcaacccccccatcattcccatgtaacaaacctgcacatgtatcccctgcatctaaaacaaacaaacaaaaactactattggcttgtgttggccacaagataatgtacatgttctttattgtagtatttaaagctctgcctacctttggccttgattaacattacttcttccatggaggctatagtccagctatcctggacctgtccgtttcattaacaaatcatttattttgtcttcacttatgcctttgttgaatgcttttcctcttctggaataccctgctatcccttctgaggccagtgcactttcaagtaattcttcaaagcccagatcaaatctgttctcttttgtcaaatcttcctagacttctcttcatacctaccttcttctctctgaaaacaagtccttaatatatccttatactcttaattatagcccgtgcccctgtgaaatcattcataaaattttatcctgttttgtttttatgtatttccccagctgaaatgtgaacttttgaggttaaataccatgtcttgttcatatttcttttctcagatttaacatatttgaaaaattaatgtataaatatctattgtattttatttcattagtcatcaactctattaataaattttatggaatgttacctaattttacctttctggagtgcgatgacgttttattcattcacttcatttgttagacatccatcatttacctttcttctcaccctttgtctttccagattaaacaaacttaaattctttgtctgttccccattccgttaattaagtctttctggatttttttccatatctcatggagcaggaccccaggccaggcctaattagggagcgctatggcaactgatagcaccattcattttaggtgaaaaatattaaacactgtcacaccaccatcaccacctcttttcattttagcttgcttttcccaggacagctcccaattctcattgaattgcagagcagttgcaattatttccaagtcagtggcttattattagtttgtctctctctgctcaacagtgcaaatcagagtgtgttttacttaaaattatgtgcattttagtgtatggtactagaatgttagctcttactctgcctttgaacatgtgtctttcaaagcattgtaggtcaactctgaatcaacttttcactggaatttatagaaaattttaggctatttcaaagccaacttttattctctcaaaaaaagaagggaaagatgagaaggaagagtataaagagttgaattagaagcctgaagtcagtttctttatgtaaaagtttgaaaacaaaagcatccccttttgaaacaaaacaaaaacaatgaacaaccacttttagaagccagttcagactttagctgtgttaagaaaagccatggcctgctacctagttcagacgtgatagaagtttgcctgcctcaccaatagtctttgagcatttcttttgatgactgaactgagttactgaaagcccagataagtgagacaataggtcaactggaacccaagaagtggtgagcagaggtgaatgctttttaaaatagagaggagcaaaaggaaaagctttcattagataaactatatatttccctcgctctgtcaaagaatagcatttcagtttttttttttccctagaggttctggcaaaatttcccttacctggaaagctccaatgtagtaaagtgaaaactatttgagcaccaatgttgttttgggaataaatggtctaaaatgcttgaggagctactcatgtcattggatttttgataagattggatttttcccaagatcccttgacttagattctaagaaaaaataaccctttctttggggactttgaggcaaaaatgagctgttcatatttgctgtccatctctgcaaaccaaggttctcttatggtgagaagtgtatattgattatctgagctgccacctctgttacgcagaaaaaattacatttgcaaatcactcaggggaagttcatagcaggggatcccaagctcactcctgtcttatagagcctctgaacttcactcctaagcattgcattttggccacaagttccttttctgctcgatcttacacttcctatgccaagagtcagctcattaaagaacaactagatgatattccaccaaaatgaactaatgttttaaaaaatggacataagcttaaataaaccaaccaaacaacaaacaaggcaacgtgtgaagcaattaggactgaaaataaaactatgtttgcctgaatcaccaaacttaaagttctcagcattctctgcactgaatatgtagcatggcaatatttcatttagtttgattcactaagccaaatagataatttgttttcatgttttgttataaactttgaaaaaaataataaaatattattttaaaattaacacagtgtcaatagaattatactatattttcaatctgaaagtgacattagagaccatttcaactgactgcctccttttttaggttacaaaattgagacccagagaaaatggactaatgcaggtcttatataaccttggtattctctcagctcagtgatctttccaatactgcaagatatcccctctgcagtgtacactttgaggattgtaatgtgaagggaacaataataaaaagttacaaattgctgctaattctctacctcccttcattagcataagtatgtaagctcagaattgtgcttattgggaggagggactctgggctaaatgtcagtagtagatagaactagggaagtagtcccagaccatctgcatttcagagaaaaactgacccaggcataaatgatccatggaatactcttaacgttgtggcaaccctgtgttccttggtttccagcttcctctcagctcccactcttagttaccagcttcctaccagtttgcccttcataaggcttagaaaaatctttttaagtcatatattcctgttacttgagtcctttccaccaatttcttcacaaatggctattaaacatatgcaaggatgacacatcttcctgtcattcagctatcttggtcactctcttctgaacacattctatttgtttcatggtcttttaaagaggaggagcctacaattgaacacagactccaggtacactttgagcagctgaaatcagatcaagaatattatctttttctttagagtccacatttccatttacacagcctatgctcacatcacccacatcatcttgccagctcattgtgcttacagtcaactaaaatcttagtctccatatgcagctatttttataccaatttttgtttccatgtacttgtgtagtagagatatttttacaaatgcaggactttacacatgaagggacttgaaaaagtttatggaaagtggaattaaatcataaaaattaaaagttgtatactttatttctcaacataagttctatcaaggtcaagacgcttttgtaagtgatgataccagccatttagtctttctctaaagaactgaaggttctgggaatttgaccatgtcaatgcagtcttttttacattattagctgaagaaaaatgggtggcctttacagatttttaaagattaggaaacaaaaagaagtcaaaaggagccaaatcaggactgttaggtggatgcctaatgctttcccattgaaactctcacaaaattgcccttgtttgatgagaggcatgagcaggagcattgctctggtggagaaaaacgcttgttaaagatttcctggacatttttctgctaaatcttcctctaaacactctcataataagcagctgttatcattctttggccctccagaaagtcaacaagtgaaacaccttgagcattccccaaaaaatgttgccatgacctgtgtttttgacctgtctgcttttgctttgactggaccattccatctcttcatagccattgctttgatcgtgctttgtcttctggattgtgctggtaaaaccatctttcatcccctgttacaattctttgaagaaatgcttcaagatcttgatcccacttgttttcaatttctactgtaagccctgctgttgcctacagctgatctgggactaacagttttggtacccatcgagtggaaaatttgctcaactttattttttcagtcagaattgtgtaagctgaaccacttaagacgtctatggtgttggctgtaatcccagcactttggaggctgaggcagtggatcccgaggtcaggagatcgagaccatcctggctaacatggtgaaaccctgtctttactaaaattacaaaaaatttagccaggcgcggtggtgggcacctgtagtcccagataatcaggaggctgaggcaggagaatggcatgaacccaggaggcggagcttgcagaaaaaaaaaagatgtctatggtgttggctattgtttctgctcttaatcattggtcttcttcaattaaatcacaaacaagattatttttttccacacaaattgatgtggatagtctgccactgcgggtttcatcttcaacatcatcttatcccctcttaaaatgagttgttcacttgtaaactgctgatttggggagggcattgtccccataaactttgtgtaaagcatcaatgatttcactattcttctacacaaactttgccataaatattgtttttttcttgcttcaatattagaattcatgttactctgatatgtgctctcctgaacagatatctttcttttttttaatttttctttcttttttttattattatactttaagttttagggtacatgtgcacaacgtgcaggttagttacatatgtatacatgtgccatgttggtgtgctgcacccattaactcgtcatttaacattaggtgtatctcctaatgctatccctcccccctgcccccaccccacaacggccccggtgtgtgatgtcccccttcctgtgtccatgtgttctcattgttcaattcccacctatgagtgagaacatgtggtgtttggttttttgtccttgcgatagtttgctgagaatgatggtttccagcttcatccatgcccctacaaaggacatgaactcatccttttttatggctgcatagtattccatggtgtatatgtgccacattttcttaatccagtctatcattgttggacatttgggttggttccaagtctttgctattgtgaatagtgccacagtaaacatacatgtgcatgtgtctttatagcagcatgatttataatcctttgggtatatacctagtaatgggatggctgggtcaaatggtatttctagttctagatccctgaggaatcaccacaccgacttccacaatggttgaactagtttacagtcccaccaacagtgtaaaagttcctatttctccacatcctctctagcacctgttgtttcctgactttttaatgatcaccattctaactggtgtgagatggtatctcattgtggttttggtttgcatttctctgatggccagtgatgatgagcatttttttcatgtgtcttttggctgcataaatgtcttcttttgagaagtgtctgttcatatgcttcgcccacttgttgatggggttgtttgtttttttcttgtaaatttgtttgagtcattgtagattctggatattagccctttgtcagatgagtagattgcaaaaattttctcccattctgtggttgcctctgaacagatatctttctaagtgcctcaaagtagatcctgttcacacatgttataacaagttagtgcaattttattttggtgcaaaaaaattgaagtccatacgtagtttcttcataatatgcttcttccatgaacgttttgaagtctctttgtatctgtctctgaaattataatgtgttatatttggctcatagttctatcctggcatgaatttggggcatgatgattgtcattcaacaggctagttactcctactagttctttgttatttacaaactatattttctcactcatgacttggatacaaatgtcatagaggacaaggaaaaggagatcactagagacaaattaatcagctactttaatatggttgttcattcatttgtgtgttaattgtgctgtcatttatctcatagtttttacctcatccaatagcatattataagatactttgcaaaatgccttgctgaatgtgaagcacatctacccatttccctgtcttgtcaatttaatcagcctgctcaaaaggggactgaagttagtctggcaagacatattcagagtgtgcccatgctggcttctggtgctgattgctccctagtatcagagctaagtcaatattcttggaaatctttcatgagggcccagaaacataaatattttcaacactacctcctcatgaatactggtcttttatttattcttactaaggattctgttattatttctggttcaaaagtaaatctctttgacagaaaaggcagatgcaaagtaggggttatctattgattccaggaattgtttgacaagtagcatcattacaacagtgactttaacaatgctcttatttactcatttttaatgttgcccttcatataactaaaaaagtctccagtcctgccttttttggcctccacatcttttatgagttgtattaggttttgtgagtcagaccttattcttgattatatgcactgatttttatcttttagaatcaccatttaaaaaatacggctttgtcaaaaagttcctagttgcagctatatcttaatcttatggaaatttcccctttattctgtcagtatttctcagataatgatgatgatgattatggagatggcagtgataacaacaaaagtgttataatagctaacatctattaaatgctatgtgccaggaactattctaagtgattttttttcatatcaattcttttcatttttaaacaatcatttgagataaattctataattttctccatctacatcttacatatgatcatatgaaggcattgagacattaagtgacttgccccaaatctcatgattagcaaatgttagagctggaagctctgcattctgatttcatagtttggaatctgaacctttcactctattgctcgagaacacaggttagacactgaaggattgaactgttagggcaatcatgatacagtttcagaacatctcataggcaaacttgtggggcatacagagttagtgtggtggtgtgatctcggctcactgcaacctctgcctcccgggttcaagcgatcctcctgcatcagtctcccaagtagctgagatcacacaccactagtttgttttgtatttttagtagagatggggtttcatcatggaggccaggctggtctcgtactgctgacctcaagcgatctgcccgcctcgacctcccagagtgctgggattacaggcatgagccactgcgcccaggcagaattagtttttgacatgcttcacctcctcttctgcacatacagctaccctcactgtatcttgttgccatcatctgagtttcctctacttgtatgctgtccttatctcttcagcttaactttaaggttctgaagagtacggtttattttatacctactcctttgtttcccacatactgtagccaagcacaatgctaaacagggggcatatataaaatccttgtggaattaagtgacaaactttgcaattcatatgagatatgttctcctagaggaggtatgcatgtgtgcatgcacggtcatgagctcacatgcattctcaaaagaaccgtgggcattaagggaaacaatgcttggcatggagcaagtactcagcaaatatctgggaaataaataaatgaaagaggcagagaggaagagagagtttccctggaataagatcaatatcaattgtccccatttcttatttctgtaaaatacatactcttttgaaccgttaattaattgatataacacattaacatcttctattcaaatcggttgtaattatgcaacaattttcagtaatttaattacaaattaaattaaaaacatgagggtgtaccagtgtggaagtatatatatatatatataaaatctccaagaaaaaagaaaaaattatatttcatgatttggaggataaacaggtcgactcctagtatcattcagctaggtgaatatggttttattatcttagtatctggctaaattctgaggtgcaaattgactcagacctattcaaatttaatatcagactttagacaaatcctttcataacaaaaaataaatggagaacatatgacggcttaggtcttttttatataattatatggttcccagagggaagttataattgaattataagctgcctcgtgagtattctagccagtgtttagagaaccacaaagcagagctgagcaatttttttcaccagctagaatgtgaacaagacaccctataattcaattataactagcctccaggaaccatataattatattataaagtagtttggggaaactacaaaactgaaagtttttcaacacattgtatatatttttaaaatgataatttgataattttatcttatgtctcaagtgtcgtgaccacagagatttgaaaacactatttgtagccttattcctatgcacttttcaaaacttttgcgacaaattatcattctagaggtccttagattactttaccttcattgtagatctgtctgtagacccatacacatcacttaaactctttgatcctcagtctttccacctataaaatgatgggatttgacttaggtgatctgtaaagtactttctaacactgacactaattgaatcttgtattagtcagggttctacagagaaatagaacaaataggatgtgtgtgtgtgtgtgtgtgtgtgtgtgtgtgagagagagagagagagagagaggagagagagagagcgaaagttgggggagagagaaaaattgattataaggaattatcttacgcagttatggggcttggaaaccagcaggctggagatccagggaagagttgatgttgcagcatgcgtctgaaaggcaatctgaaggtaggattttttttttttgaggcttccatacttttaaggccttcaaccaattgaaggcattatggaaggtaagtggctttactccatgtctgctgacttaaatgttaatcatatctaaaaaacaccttcacagtaatatgtttctttctgtattgggattatttcacatagcataatgtcctccaggcctattcacattgtggcaaatggcaatatctcattctttttcaggactaaataatactcctttgtgtatatgtaccacagtttattcatttgtctgttgatgaatacttagaaggaaaaaacattgcatgatctcacttatatatgtggaatctaaaaagaaaaataattgaatatatagagatagagaaaaaacagtggttagcagagttaggggttgaggaagatgaaatgaggagatgtcggtcagagtacaaagtagcagatatgtagcatgaacaagtctagagatttaatgtacaacatgaggactatagctgataaaattgacctgttgcgggattcatgctaactgtgtagattttagctacttttgctacaaaaacaaaaaaaaatgggtaactgtgagatgatagatatgtcaatttgctttgctatagtaacttttttactatcggtatggatcccatgttatatgccttaaataaacaaaagaaagtttattttttaaaatattaataccttcacagcaacatccagacttgtgtttgaccagaagatgggtaccatggcttagctattcacacaaaaaataaatcatcacaaatctgtacagtaagagaatggggtgttattcaggtcctacttcttctgattgtggattgtcttttagggatatatcttttaggggcaatttcattcctttttcatccataaaaatgaatgaaattccatagagcagaaagtaggctactggttgtgagggggtaagaagagagcaggaaaggagaagtgactactaatgggtgcacagtttgtgtgtgtgtgtgtgtgtgtgtgtgatgatgatgaaaatgttctaaacttagttgtagagatggttgcacgactatgtaaacacactaaaaaccattgaattttatactttaaatggatggcatgtgaattatatctaaataaagttcttaaaaagtaatgtatacataggaaaagaattcaaagcaattgaagagtttgtaatggaaagtcactctcaccccagtctgcacttacccccaccccattccacttgcaattacagtagtaaccactgtcaatattcctgtattcccccaaatattgttctgtcccttgacttttcagtcaatattgtttttttaaaaactttctgtatccccatatatacatctttaccattctttgaacagctgtctagtagtccgagtattaggcagatgcaccaaaatctaaacatttccctcctgaggaattctgcattcttttcagtgcttgtgaaaatgctgcatggacactctttcatatctatttacaagacagtgcaaaaatatatctgaagaataaattattacacataaaattgtctagtcaaaaggaatgtatattttagattttgataagttattgccgcattgccatatacaatagttgggccaatttatactccctttgacagtacttcacagtgtttgttgatgcattaacactggatattatcagactgtttgatctgtgtcagtaggataggcaaaaaatgattcctcatttcagttttaaacagtgaatgagatggaactttttttgtccatatgcatttcttttttatcaattttatgtgtgctttgtttatacttctattgtgttatcggtctttttattattgacttctaagatctcttcaaacattaagaaaattagccccatgtttgtcataaatgctgccaagattcaccactttttcttttgtctttatattgtgtttatgatactttttggatggatacatttttaaagtgttcattttgttgctttcaaatagattggattgtacaatagaaaatacagtccaaactgaaatcacactcttatgtcacttattttttgaatagtccatgaagctccctctggaggaaaccctgaaactgtcagtggtttcagtattccactgtgcaatatcctgtcctcatggatattggatatctcttaattatcatcctgaagtttgctcttagataagggtatttttattgtttattttaattggccacagattgatcaataaaaacatgataacattgaacagatttcagatattttttcctttgccagggctttctcactttactcaatatagcagctgtcactgtgcttgcattatttgctaatttaactctattactcctttcatataacacataagggtctttacaacacacatttttaacatggagacaaaaagtcacataaaatggtttaatgtacaaaatggaattataaacataaaagactggaaaataggatattaacttttggaactactttacttttttcctcccctctctctttctctttccttccctcactcatttctattttcatatttttccttctttacttcttcccttgttattatgaaagtaatacatacagtaatgtgtgtgtgtgtgtgtgtgtatgtatgtatagatatatcattacaaacagaacatataaaataaaataaaagctctcctgcccaccccggtcacttgactctccattcacatgcccgagagggtataaattttctttatgtgtatttcttgaaattctatgtgagtgcaaatggatgggtatgtattagtgcatgtgtgcacattagaacatattatcttgcataaaagatatatatatgcataaaaatgagagagcatcctttaggaataatcgactcaggctgtacattggttctaatactgtcttcgttaaaaattttcttgggatttctggttattgcttttagaccttgggaattctcattaaatatttttactggtggatttttttttgtttgtttgaagagggatttgattttggggaaaaaccagagactatttggagtcaagtctgttgaagacaggtgttcaaaatatgtggtatgacatgatcaaaaatcagtagagttaaaaagctgattgttttaagcagctcatagacaaacattacagataattatcaatgaggttttacaaaaacgtttggagtactgacagcattgttggtatgtttttggtattacaagggtgacagaatcaattacggagctggagttcatttgaatgtatgaattctactgtgctggtttttggatttcagagttctgctgttctggttacaaaatttgccttagatcttctccctacaggcctaagaagcatcattctaggtcatcagtctgctgcatccagcacagacttctgcttctgacagtagccctggggtataatgacaatcttagaaatgaggaagagcccctggattttcctgcagatctttaattaccagtggtacaatggctctttctttcattaaaaaatctattatttaaaaaagtctaattatagtctgtttctgaaacagataagttgtttcagtttagcttaacttaatttcttatctcttcagataagaaagctatacatcttaagaaattctctatcaccattctcaccattcatattgagatttttttaacttttcaaaagctgtcacttagtgaaataattattatagcctaacattcaataattccttgcttaaagacagcttatattttcactggctttgatgaccagtacaggaatttagaatttatattgatgaagagaacaataataatcttgccaagttttggtaagaaccatggcacatataattctgttttttttttcattctgcaacatacgcaaatatacaaatagtagatgcaacagaactaggaaaaacattgattgcactatgctgtaaagaagatttatggtactgtgtgtggacatgaaagtaattattaaagccattaataagaagtgaaacttgatttctaagcatgatagagtagataggaggacgctaatgttttggactgttaataagcgtcctgaaaatagtccctggctttcaaaatgaagaacagtgctctagaatacctgcatatttccttcaacaatttttttcttataagatacatagcaacacaacgtcgattcacttatgttttaaatacataattgttcaggtttataatgaaactctgtcaggtggcctgagcttcttgttcaatgaggacatccatgctcctcggcactggtctgttccttttcagaacatggcttgtcactgcaaaggaatggacaaaatgtgggtatgagtgtctttaagtggttttattgaatttatatttgcaaaaatgccattctttcattcaaaaagtgtattgaatacctaccgtgtgccaaccactgtggtagttggtgggaaaatagaaataaagtagatgacatctgcccttcaggaactcctaatctgagaatagaagttgaagtagggagagatttgattatcagggcaatcaaatatataatgttctggaaaagaagtatcttcacggcagtgaaactaagggctttctcaatctcttcctccattaaaagaataaataaaaagcaaacctgtattcaaatcccagccctgacacttagtagccgcaagacgtggtgcaagttacccaaattctgtgaacttcagttttctgtctgtaaaactgacgtaataataatgaccatacagaacttgagtgcactttataatgtatacatgtgatataactagtcttttgtgaacagtaaataaagggcaactaggatgatacttattaatatataatttgcttatgaggatcgcatcatgtattactgagtttttttctttttggaaataagacttttacaatttagaaagtgacggatattggagaagaaaatgactatattttccgaaagccttactagcacttacagaatacaccaaacatacttttatgctgatatattttgtatctgtccagcatggcatgcatgttatgcttcccttaaacacagtaatttcacttgccaccgaactgtctcacacatttttcctccctctttccctcacaaaggtcatgccaagaaaggcagtgcacagaaaaatgttaccctcgcctcctccacatgtctccgttctattctctggtatcttccttgtcaaatcagactcactttaagacatcaaaagtcagtgttgaataaagaaacaaaaacacttccacctgacttatggcagaaactccttctcttgctgttttcttctctctgtcatttatgttgatggttttaagctttttctacttaatggtgaaatattcagtcatttggaaagaaatcagccaaattatttggctatttatagacaggttttttttaaactgactgcacttctggaactttttatcatattttggacagacttaaatgtatctctcaaacaagagacaatatttgccttggagcaggagtgtcaactgtgttaatccgttctcacactgctgtaaagaaatacctaagactaggtaatttataaagaaaagaagtttaattagctcacagttctgcagactgtacagaaagcgtggctggggaagcctcagtaaacttataatcatggcagaaggcaagcagaaaacaggcacgtcttgcatggccagagcagggggaagagagatgcggggaggtgccacccacttttaaacaagatcttgtgggaataggatatcctatatcctgtatcctcactagttacaatcctgtgcagaaaaaaaatcactatagatttagttgatcttgggcctaccctgtgactaaatgctgatactagtttacttacctcatggtagaacgatggactttttaaagctaaaaggtccttagaatttgattagtctaatggagttctcaagtttaccttttactttttaagcaacagaaagtgttttgttttgtttcattttattttgttttggcatagtggtttagagcgtgggtggtgaagccagactgcttgggctgaaatctgtgtctcttatttactgtcttcaagaacttgatcaatttacttaacttgtctgtgtctcaattctctcatctgaaaaatggggatcatattaccacccatttaataggctttttctgaatattacatcagccgatacatgaaaagcacttagaaccccgctcagcacaaagaaagtgacatttaaatgtttaatatgtcttccaaaaagtaatcttttatagaacccaaacctacgatacagcaggcaaaataaaagctactctggttgaatggaaaagggtggcagaggtgaagcactggtcagccataagccacaccccaccctgcagccactaccagtgtacctccatttccttttccactagtaggggaagcctgaacataatttgaaaatctgaaaatactttgaaaatcactaatctaagcccatcacttctttttacgaatgagaaaattgcttcaggcatattaactcatttgatcttcacaatagttcccaattttttttcaaatgaggctcaataacttgctcaagcttatatggctagtaaactgcagagatgggattcaaatacacctagaaaagcaagccaaagggtacagacatttttacaggttagctaccacatctatcaactgcaaagaacacagataccttctccaaagaggctctttgattttggagtcatctgttaactttgtttaactacaattaaattggaccttagtaaactagagcacaataaatattaaattattcttctctaagattctcacagtctctttctgtctttttgttatagttttagcagctttcatgtcaacatactatcttaaaatgttttaattacaaataaaaggtaactttgtgaggtgatggatgttttaatgagcttgattatggtaatcatttcacaatatgtacatcaaagcattcacgttgtataccttgtatacaatttttatttctcagttatacctcaatcaaacgaagaaaaaataaaaatttaattaaaattgtgccatttttggaaaatgtactttagggaacaacaatttcactacttccgttttctgttggcgaagcccggaacatttgtccttctcttaaaaacactcagtgctgttggacagaagactgggggttgtatgatctgttttatttgagagatgtgtccactggattaaaatttttaaaaatatttttataatatcaatcttaatgcacaatatgaactaaatacccttttcacattactcttattgtgtctttaaaggggttgggaaatctagtcatttccttttattagatatttggttgtgtggcactattataggagttcagttttctcccacaagagggtaagcaaggttttggtgccttaggtattggtgactctcctcagtgtaaagtgtcttcgattaaaatcaaatacattaaatttctccagtgcatccaattactttgttaattgaaaaggacagcattcagtttaattatgtgttctcgtttctggcaatgcaagaaacaaccattcgaagagccatttggtactgttcctatttggccctgtccatttgagatttcccaattttctgtgattttggtctgtcgtcctaagtatggtttgtttgcttcactgattacttccaacagcacattaaacgcccccatgggaccatgctttctgtctgacatttgatattgtttctgctgtcacttttaagattctacatttctccttgtggttttgatttgcatttctctgatggccaatgatgatgagcattttttcatgtatctgttggctgcataaatgtcttctttcgagaagtgtctgttcatatccttcgcccactttttgatggggttgtttgtttttttcttgtaaatttgtttgagttcattgtagattctggatattagccctttgtcagatgagaaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcaggtggttgtagatatacagcgttatttctgagggctctgttctgttccattggtctatatctctgttttggtaccaagaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattgtgtgaagaaagtcattggtagcttgatggggatggcattgaatctataaattaccttgggcagcatggccattttcatattgattcttcctacccatgagcgtggaatgttcttccatttgtttgtatcctcttttatttccttgagcagtggtttgtagttctccttgaagaggtccttcacatcccttttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgcctatcagcttaaggagattttgggctgagacgatggggttttctaaatatacaatcatgtcatctgcaaacagggacaatttgacttcctcttttcctaattgaataccctttatttccttctcctgcctgaatggcgatcattaaaaagtcaggaaacaacaggtgctggagaggatgtggagaaataggaacacttttacactgttggtgggactgtaaactagttcaacccttgtggaagtcactgtggtgattcctcagggatctagaactagaaataccatttgacccagccatcccattactgggtatatacccaaaggattataaatcatgctgctataaagacacatgcacacgtatgtttattgcagcactattcacaatagcaaggacttggaaccaacccaaatgtccaacaatgagagactgggttaagaaaatgtggcgcatatacaccatggaatgctatgcagccataaaacaggatgagttcatgtcctttgtagggacatggatgaagctggaaaccatcattctcagcaaactattgcaaggacaaaaaaccagacaccacatgttctcactcataggtaggaattgaacagtgagaacacatggacacaggaaggggaacatcacacaccggagcctgttgtggggtgggggcaggggggagggatagcattaggagatatacctaatgttaaatgacgagttaatgggtgcagcacaccaatgtggcacatgtatacatatgtaactaacctgcacgttgtgcacatgtaccctaaaacttgaagtataataataataataataataataaaaagattctatagttctccagcagtcgggttctagagtaatctgcccatgttgcctacatcagaaccatttaaaaactacaagaaaacatgaataagggtgtcacagcattgatagttctgatgagcacttttaaactttctattattaataataatagtaaataaagaaggtaaagaggtagacatcaaaatgacaacccatagaatggaaaaaaatatttacaaaccatataagagagtcatatccagaatatataaagaattcttacaagtcaataatgaaaaaagaaatgaggcaatttaaaaatgagcaaaagatctctaaagaaaacacacaaatgaccaataagagcatgagaagaggttcaatatcattagtcatcagagcaatgcaaatctaaaccaagaagagatactatgtcacacataggaggatggctataataaaaaataaagacaataccaagtattttgagaaactaaaacacttatacattgcttgtgaaaatgtacaatagtgtagtcactgtggaaaagtttgtcattgcctcacaagcaaaaagttaaacatagtttctatattgcccagcaattccattcataggtatatacccaattgaaaatctatgtccacacaaaaacttgtactcaagtgttcattgtagcttattcataataacaaagaagtggaaatccacaaaatatctatacaatgaaatatcgttcagccataaaaaggaatgaagtactataacagggataaacctagaaaacattatgctaagtgaaagaaaccacacacataaggccacataattgtttgattccatttatatgaaatgccaaagatagccaaatccatagaaatagaaagtagattattggttgccactgttggggagagggaaataggtgtgactgtcaatgagtacagggtttctttttgtggtgatgggaatgttttggaattagtggtaatggttgcacagttctgggaatatactaaacaccactgaattgtacactttaaaagggtgaattttatgatatatgaattatatctcaataaagctgttaaaaaacaggaaaaatagccaacattgagcacttatgtgttgtaggcattgcacttggcagctttgtatgcatgatcatatttaatgttcacaacaattatatgtacatcggtactattatttcctccattttacagatgtgaaaattgaagcttaataatggtatctaagttacttagtaatttgcccaggtttccagagggtaaaactccaagaactagaattcagaatctaggtaaccatcttgaacttttaactactacatgcatttctgcctacattttttatgaaagcagaccatagcagaccatacaaagcacagcagaccatacaattcactcatttaaatgaactacccatttaatagtttttagtatgttcatagatactggcaaccatcaccacagtcagttttagagcattttaatagtcttactaacaaccttcacccagtaccctttaaatatcacctctctactccctcatccgcccagtactatgcaaccatcaatctgtctctatggtggtagattgatactgccacctatagccatttgcatcattgtatattctattcagattctgttagtcaatttagataagaccaaggaataatgagacaataggattccctttaaaaattgcttggaggccaggtgtgatggcctgtgcctgtagttacagctacttggaaggctgaggtagggaaaatcacttgagtccaggagttcgaggctgcagtgagctatggtcacacctatgaataaccactgcactccagtcagggaaacatagtgagaccccatctcaaaaaaaaaaaaaaaaaaaaaaaatgcttcgaaacagcatcatttaaacggactcctaaaggcaaaggggaaccattacaggtttagatttgccctgtttctggaattacctacattattttactgagaagctgagtctactcaagaaaaagaatatcttgattgcagaaagtatattttgcttttgggaaaaattgcagaaattgtcaggaaatttctttgcctttaaaattgggacagtgccctctagctaaatgattttgctaagtggctttgctagaaacctttcctgctcctcttgtcctgaagctactacttttcctcctgaccctcttgacttcaatttgagtgtatgtgttccagttaacaagtaatttaggggagtgtcaaaaggtaactagtgtcccctgggttacaattaacctaaaaattaaaaggtggagtttaaaattctcattaagtataacaaaaacataaaaaggaatttttggattggagttggatttagaaagtcacctttgaattaatgaaactgaccatacttgactatgcaccaaattacgtatttgagagaagatatatattctatagtttagtggcaattagtggctaatgcaaaatgagtagaaaaaatttctaggagccgtgttccatgatcccattcactcacagtgcacatactaatgtgctccagttttaattacctctaatttctgaaatatgcttgtgagtgttacattatttgaattaagaattaatgcgttctcacttaacctggccagatatttggtgccatcatatatccctgagaaattttcttgatgatttatttttaaaggtagcataataaaaacagctggggtctctaaaaatgatttatagtaaactcttatagcctagtagtaaattctaactaatatgttttactcataatggatgcctacagcttgtcaactctgtgctaacaggggaaacaatattgttattgctcgtactgtataagcttcaaacacttatgttgtgctggataagctcaaaccatgttggatgcttaaaatatttaataactcatatacgctaatgtttattttacataattccaaaaactgtttctaaaagcaacaaggttcttattctaaaatagagtgtagaatcacattttatcgaagtcagtttgtggcctctcgaagcagaaatatatgcataaaataaacatctactaaacaggaaactttggggaggaattaaaatctatcactgcttttaaagaatattcagatgtgtataccctccttttgagtatttctattaaatggtgcttgggcagtaataagcctcatttacttatttaaatgtattctccttaccccaacccccaaaacacacacacacacacacacacacacacacgcatgcacacacacacacacatgcacacacacacacataattgtatgagtaaatctgctatcagttcttttgtctcaattttctgagttgtctggctttttgggaagttagttcatttgggggcatgaaaaggttagaagtgaaatgaagatgtcctcactgacccacattcggcaggacatgtcccttgagttgtttagaaatttagatggccttgccagttcgtttttgacctgtggcacacatttctatagcagctggttgcagttaggttttcttctgtatccgtgtagcagagaaaacatcattggcccatttgaggatggaacttcaaccttggtctcattagtgcttggctttagccacctgatacgggattacatagaagacggtaagcagcaaaagacaaataggaattttacagccattgacaaagaagacatagtaggtatctaggacttttctccccactagaaatgcttgggaaggttcacatactttctttggcaagccatctaagatatctcatgtctaaggttaccactgtattcaaacaggctgcaggttttttgactaaagtcaaggaaatatttttagttggtaagcagccttgattctttataaaatacatacatatggataaaaataacaccttttaatagggtaatatatttgtatgtagtcccttcatccttcaatacatatgtaaaaagtgaacagatttggttatttagtagacctcctctcaacttggtttataccaccagaaattgattggaaatgtttaaatatttttttgtttctgtttttaaatattactctttcaatattttgcttttcccaaactacctccaaataaggagtgcaaatgtagaaactggttgctcttcttcaagagaaaaaaaagagaatatgtttctagtgtttgtagatgaaaaagtggtgtactgaagtgtatgtagggggccttttaattgaaattaaattaaaattaattgatgaaagtgtttttggcttaaactgaatgagtcactgatgtactttaaacccttgcaataaatgaagtatttgctggtagaagagaatctggggctgactggtgacgattattcactgtcttaattgttggaaatagattattttctacctgcactgaagtcacaatgatgggcagaatttccatgggaagtgttatgcctaactggcatagtaattaaaatgtgggttttctgaatcctgaatgtagatttcacaattttcctggaatttaatatagatcgtctatagccacaggtagtaaagtgttaaacagtaaaggaaaaacaaataaacatgtttccatcttccctaatacataaatgcacaggaatggactgtatcttaatctagaatctagtttgctttcaaccagtaataaaagcagagaccactatatatagcttttggaattaaatagaatatatcattagtttaaggtatatttcaggaagaagaactaaccattagaaaacaaaccacaaatggaatactaacgctatggagcctgattcacccctcctttcctgatatggtttgactctatgtccccacccaagtctcatctcaatggtaatccccacgtgtcaagagacagacctgtgactggatcatgggggctgtttcccccatactgttctcatgatagtgagtgagttctcacaagatctgatggttttataagtgtttgacagtttttttctacatacacttgctctcttgcctggcaccaggtaagacaggactgcttccctttccgctgtgattgtaagtctcgtgaggcctctcaagccatgtggaactgtgagtcatacctctttcctttataaatttctcagtcccaggcagttcttcatagcagtatgagaatggattaatacccttcctgagagatcttagtgcagttgcaccctctctgccccgtgctcaggcataattccaaatatttattgttgagataattgaaaatgtaattgttgtatgttctaacaaatttgaaatttttcctcaggatggaagatttggtagtatgtttgctttccattctttcagatggttcatttgtcattcatagagtatccttgtataaggacttggatttaatagacgtgtgaaagttttcaaggttgacaatatgccacaacctggaatttatagtctctgttgtggttattgataatactcaggcttacgaaattcatttattttttattattattttttaattttttggagccaaggtctcaatctgtcgcccagactggagtgcagtgatgtgatcgtagctcattgcagccttgacctcctaagctcaagtgaccttaccacttcagcttcccaagtagctagagcaacaggtgtgtgccacgataccaggctaatttttaaaaattttttgtagagatggggtctcactgtgttgcccaggctagtctcaaattcctggacccaagagatccttccacctcagccttgcaaagtgctgggattataggtgtaagccaccacacccagcccatttctattttaattaggatctactgaggaagattccacagaatgtgatgattttataattgttaatattcttttttttttattttttttttatttttttttatttttaatcttttttttttcctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatgtccagtgatggtgagcattttttcatgtgttttttggctgcataaatgtcttcttttgagaagtgtctgttcatgtccttcgcccactttttgatgggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggtttattcttataatttgtgagatacctattcatttctaaagatcaaggtcaaattagcctgttcctaaactttctacctagagttgatttccttgcaagtaaatgcaattaacttgcatagtgtactaaccagccagttgtcaaactctaggcctgaatctgacttttggcacctatcatccatccagatattgtaaaaattttagcatctagtcaaacccttgaactttgtcagctgatactgtctatgccttgcctaataatattctctacttcttttaacaggctcacttaatatatattacaaaagaggaaggatttcacatgaatgtcctactcttttaatatgtgaatatttttctctttttttcctctccaaactgctcccacctactgcactctggtggctgaaattccttctatagagttaaggcatttttgttcaaagaggtccatgctaaaataaaattacctgtattgacatatttttgcctgattagtttatccaggtcattttcagatttctcatttgagagctatcttaaggggaagataagttttggtgttgctcaggagtgggagacaaaggcatgtctcaagattgtgttcttgacaattctgctattaaatcagaatattgtgtgaaattacaggtgttacctactaagataagtaaggggagagacatagaaatagggaaagaggacttaaaaaggaaaaatagctcttcaaagaccaaagttacctactttactgttcttcacaagcctgattcaaacctctagaagtaactcagctcatttctggtgttcacttcaaggtatattgctgcttttaaacttaaactttgtctaattctgtgatgaaaagaaatgaatgaacaacctcaactttcaagcagttttttctctaagagcactgaagtcatacttaaagctgttgaataaaaagtgccattaattgaagtatacgatatattcagatatgagaggttttattattcactgaaaagtacaatgaatactatattctttaaaagtcattaaagcacacatattctacttgactgctgtatttatataagcattgctagcatttgccctttttatgtcttcttcaatttttttctcctactcttcctcctctttatctttcttactgtttatccatgccttcttcagctatcctcaacatcactaagctaagggaatatataatcttatgagatgtactattaagtggtaccatttgagagtgtgtctctccctctgtcctgtaatgtgcctgaaattctcagaattttggttatggtttgtgattagggcactagccccaaaacatcataaaaatcataatgcaaatgtccaaagcaagtacactcacatttattccttagaaagcagagagaagattaaatgatccattttttaagacttgtgtaacctagcatgttagagttagaaaggatctttgaggtcatgaacagtttttaattaaagttggcttgttttatttccttttcatttgtgtcagtcctttctttagatgatatttaaagataatgaaagttcaatgaggaaaatagatgaattaggagaacattaggactcacctctgctcgttactggttctgtggaagcttaggggttctgtgcagtgaaaaattgagctcatagttctggagcctttttttgtggagaaagtgtgaccagaagttcaatattctgattcccaatccagggatctttgtatccattggattgctccctataattacctttttgtgtgaatgccttatctgaatttctactactttgtagacatatttttgttaacatgcctacacaacaatactatggatgttctaaatagtgaaatgacaaccatagaaaaataatccaaatgggaagagggaaaagtgattctgaaatagaaccgtctctggcaagacatacaatttctaagagaacctttgaaatatagctgagtatgaaaattgggtagggatgtcgcattattggtaattcttattgttttaatgattccccaattgacattaaaacaatagacaagttaagtgatctttaatagaaaagagaatgagttgtagatcaggttcttccaactccagaagattactttctgaaaacaaatagcaatatctggtgaaaacaagtttactgaggtcatgagcctaaattttattgcaaaggtcgaaaagatgaatagtatcaatttttttttccttcagctcagacttttaacatcagaggaaaggatgttatatattgcaaaatagatgtaatcactgaatccaaagagaaatgttattgtgcactgaaacactggatccaaatggaatctaattaatcaaagtatgttttgctaattaggaggacagttgatgatataacatacatctagtgatgttttaaaatatcataactgatgagagttgcccatattaagcatttgaatgggtttttgaaatagatggagtttttcaatttcccagtttgtagaaactgcaatcttagttttagagatgtgttaattatgaggcagaaaaataaatatcatataatgacattttatggtccaaacttccatagagtttcagttatttgatttttgttgtcctaagtttctacagcttttccttcagaaaatgttctatttctggatgatatgcagacaggtaaatatccaggttttgtggggacctgaggtttatgcactttgggggcccctctttttaaacagaatacaagatcgcaaatgcaaaattaggaatgaatgtgaatatttaggaggggcctatgcaagggaggtgccctgaggtttaagctttacggtaaatccactcctgcatgcagcacatactagtaaataatttaatagttgatcagtgaagaagagagaaatttttcaaaaactacaaccctttgattttggaagtcttttgatatgttaataacattcaaaaatacaaatgaaaaaattgtaatcagttggtcaaagacagaattataatgcacagtttgataagatgagatctaaattagatcaattaaactttgatagtgcagtgacaatctggtatttctttatgtaatgcatcttgagaaatgtagttacaattattttaaatcactgatagtacattttataccagttaaatgggaattaccaagaaatacattcaatctgatcaaggttaataagaaaaggctcagtgttttcagagaatacccttttgaacagacggtcttctgtaacatgtgaaaagaaaactaggatcaaagtaatgatttagttttaatttgtgacataaactgcaatttaatctaaaatcactatacttttaggcatctgattctgttttctgggttggtcactaaataacagcatccagttatcttcagttgcaataagaacctttgtgcacacactttttatctattaggttcaggtttacctatgtcttttttttaattcattagaagcttaattaaagatatatctgtatcattactagcaagacaattagaatatatactaactaatggtggctgaacaaaattgactcatgctttgggggccacctgtagagattagggaagcatttgactcccctggtggttccatttgatgtataccacagatacttgctaatgagtagttcctcctttgtcgtgcactggtgtctgaaaattcccaccatttgggttatggtttatttttaaaacgctaactgaaaaacacaaatcatcgtaaaaattaaacctgcgggaagacaaaaaccttatctgatattgatttgtgccaaatataaaactgataagagcttggctataaatccagctaaaggtgtacagtcaagagcaagataatgggtgctatttggatgtattcataggtaaacaactagaatttaaagatagagatgtgataaattagctcattgggaaagagtagaaccttggttatacttcttcctgacttgattattagttaactgtgtgactttcagaaagtcgcttgaattctatgagttgtccctttctgtatacatgaagaagtcagtccctttcagtggcagaagtctatttatttaaatacatgttgggcatcaaatattctttaagcctagtcttttggaatattaaacaatagttctttaaacttaagtctgtaagccaattgccactggcggtcctagcagtcagcatttgctgatgtactactaaattcatattcacttcctttttttccaatattcacttttggtataaaggtctaggtcaattatagttgttttgtgagatgaaaaataaattgaaaaatgacagatttataggccaacttacaattttaatttgaaaattgcctactgtagacataggcatgtcatattcaaaacagatttgagtgtccattagaccatagtgtctattaaatctactcctgttcggtcctcagagaaaattatagtaaaagtcatagcttacatagaggattatgccgtgtgtctatagtagctttcataaccaataaggtggttttataaagcaaaatatatatagcactgtttcgagtgctttaatatattagctaatttgatctttagactatatcaatgaggtttggcattattattattcctatttttcagatgatgaaattgagacacagacaggctaagtaacctgaccgacgtcacagaactcaaagtagcagatgggagagttggtgtcactctccagagtcatactgaatagagtaggtatggtaaggaaaacaaaacaaaaaaaaggctaaactgtgaaagggcaagaaacatctctacaagtagctgagcaaagctatctcacacctagaaaaatatatcctaaaacatatatagtgatgagaagctacttatagcaatgatctactggagtgcctggaatgagataaagagaaaatgtgagacaagcagggctaagtaaatgtgaaaaacaggactgtgaggctctgttattttactgacagtcttgctgccttggaataatgattacagcctttgcagaagtcacctgtgaatgtggagttccatatgcagatgtgaaacagataaagttctttcccacttgattctgttgacatggcatgtggaaaacaaggcaccatatgacaaaagcctaggaaaactagggaagtgtggtgcacggtactgagagcattccaagagcctagagagactaatttatgaggaaagattaaaaggattaattgtatacaacttggctaagtaatgcctaatgaggaacatgagaactgtctgtaagtatttgaagaacaaatatgccagggagagaagggatttacctagtgggacacaaatagatgaaactggaaacattggttgtaatttcggacaggatcgttttggcacaatagcttataaaacttgttgacagttcatatctattataccgtaaaatagtttcagaaaataaaacaaaacaagggcccagtatggcctttaagaatatcagcagggtgaacgggaaggtacagtgatgtatattgagtagataaagtataggttaaatattctggttctagagtgtaatatcccttacagttattaaggtctctgcccatcctgccccataacaatgttatagtgcaagttaaggttattatgttttgcatcttactaccccgtggtatgttgagtagttctgtgtctggttctctggatagatgttgctacaggaaaatagagggcaccaatgagaatcaaaacctgttctccagatgggggaagcattatttcaagcagagaccagatgctggaacccaggagattagagattgcaaattagggattttatttaacatagtaggtgttcacttattatctataggatgaataaaggaataaaggaacgaataaatgaatctcattgaatcaaaatatcctcatctgtaaaatatagttagcaaaaatacatatccataactaaatattttaaattaactaatgtatgtgaagccccacaaaaggtatatgttcaataaatggtagctattattatgtgttgctcattggactagcacagaatgatgtttaagctcttcctttgactacttcctgcctttgcacccttgattatgcctacttcatcaggaaggtgttgactggaatcataatacttaaactctttgggagaagtcaagagtccagagtgagccactactgaagcagtcacttttgtattcaaattaagtcattttgcacacagtggaagcctgatggtaccgctgaaaagaaaaataaattagcatgcttcacagcattgatctggtagaagaagtaaagactattttatgtcataggttgccaaagaggtttcctatctttttaattctctgtaagtagaaatcacccatgttagtaaagcatcaagtcccagttggcctttgcaatattcttatagatgatccaagttttggtgggtattacaatgcatctgaatacaaatagattttgccttaaactctgcccaacactattaaagccaaactctacacagtctttgtctttatgtctcccctttacaattcttggtacattttgacactttaactcacaagcatttcaaacgtaagtgtgttgttaattctcggctgttaaaaatcaacacaaatacgttgcaaagccacgatgctttatttagggtgaaaaataattcttttaaaagatacagtgcttgagctttcaacaaatacttccttaaaatgaatataacaaaagcaacaacaggcataaattacattcaaagagaaatcaggtagaaatagaaaattttgacgaagtgccaactgccacataatgttgcaatgacttaaagaatacatttacatttatttagggaagattaaaggcatctctgtttgtgaaatgtcaattaataaggacctgcagtttttgttagtgagagcgtgcattttaattgcttctgtggaattttaataatgattcaattgtccttataaccagattactaaccctcagtctccagagtagcctgagagataacacatagcagagttcccataatattttttatcagcttgttgagagtgacatgctattgtttctgatggagcatcacaataggacagcacaccttctccattcacaagggataggccctgagacctttttgactccccacagcctcaaatatcactctagcatataatttccctcataaaaggcagtaaagtataactgaaaaatttaacagacccttttcagaccattaatggttctataaatacaagactaaagtcatttacaaagccattttctggctaagaactagcacttccttttcactgctagcattatcactagcagttgtgtttttcttttcagggccattttttcacatagaattaaagttaattgtcatcacttcagtagagttgctgcatatacccccaacaagtatagaagagcagagttttggatgttgggcagttggccaactcactcactagttatattcaacaccaaagatccaaatttaggtgtcagcaacattacacgtaactacaggtcatggactcatggagtcacttcctgaatagtcaaaattgcaaatgttaaatccataaattccaatgatctgctgtatttactagcttaataagcttggcagttgcttttctctggttgttatagcagagtatcaactgcatttgagtcataatggactcttggtgctcttatcaactctacaaaaaatctgggaaatacatttaaaattataggacttgaagaccagcactggcctttatgctatccatactcacttcccgatacttccaaatataggtataccatttctagtaaattccatttattttactattaagaaatcagagagcattctatttatctggaaaatagaagccaaatagcagtatgtataagcattaaccacctcctatatccaaacactgtgcttgtcactatagtgaatgaaaatatttaaaacttccatttgttagttatttagtatattttgggcattgagtaatcactttacatgcattatatcattacatctaatggtgggcctataagaaattctccttgcccgtaaacaggctatagtctatttgaagtgatgtcataaaggttagatttagttggttccctaggatggcctgagaggcataggaggttttacccaaaaatgtactagacatccaatatctagttttctgagtcaactgcattttcctttttccacaaagtgaattagaatttctattaattctggtttctggtggatatctctgaagttaacatttgtatatttaatttttaaggattgataaatgtatcaaaactaagatgtgagtgaaaatttaatcttctttagatcaatctactttttgtgatttttattcaaaagcattatattgcatgtaacaggatctttcttgtctgttagagaagatcctacatccctgttggactgttgttagtttgcgagtttgctgtaagcctcccagtgatctttgatcaaaatttttattatttcccctggtacttaaaggcacaggtcccaaacttgtacctttatagcaaggtaacttactgagcaagaatttgtcgggcagtggagattaatgctaacttttgcaaatggcaatttttggtccccacttcctctggtatatagttaattaagagcagtgtaacatagaaaattctgcaaaaccaaacagattgctcaagtctagcatcttggatggtatgtagatttgttgcttttcctgaatgagtattcctgtctgtgaagcaacaatggtagtctcctgagtaatacattgcctagggagtcaagagctcttgcttctagtccaggccttgacacagactctgagacttctggcaagttgctttatttctctgggccatggtttctacagctataaaatgggatgatgctgtctgtctcacagtgttgttgtaagggcaaatgcaaaaaggttatgttgccttagaagaaaggcaaaatagacatccaaagtggtattcttagataagcatgtatgtatttttctgttgtttacatgtgtaataaaaatatgtcatgttattttatttaactgttgcagcccaaaaagaggtacagatgaataacatttggttataaacaaaaaaatgaatattgtgtagatgagcaaagtaaatttttcttctgccatgtatgcaagttgtgattgttgcagtcaggaagaggatgtggaaaaaaaaaaaagcaaatctgcagctattcagctcccatctgtatacggtaaaatgttccatatcaaaacggtaaaatgttccatagcaaactcatggttcaaaagaaggaactgtagcttctcacactttgccaaccctttgtccttcccttcctcctgctacttactgtaagaggctgctttttctactctcaacttcacagtcacccctcaagaggtttagcaggctgtatcgtcacagctttgtcttctttatcaatttcaaaatacaatgaggataacatgattatctgtagaactgtttctctacatagtactcattgagtttttggggtttttttcatatgggtcaagtcagtaagtctttacctagtatctgtcatgtgtccagcctagtacaagacaccatgaggaattcatggaaaataaccaacacagtcctgacacaaaatagtttacatgttgagataaaacattttcatatatgatactcatctcatcttccttttgaactcaaaacttacatctttgagactgtgagccatgtctaattcatcttggggtcttccacactcacactttgagatggagaattcttcatattatgggagtggcccaccccattgtgttatcgttattatctttttcccctatacaataaatgtcagtagcatctcccagtcactgtaacaaccgaagttacctccacacctttccaaatttgggataagtgctccctcaattgagagtcactgttttacagcatcatggatgtcagtttgcacatgatagacaaccctccatcaatattttctgaaagaatgaattcatgcaacatgacaatgggagaataattaagcagagcaaaaatcacatgcaagaatccttgggacagaatactagtacattagggctctgggacgtgaggctgtgttgtgctgggctgtataatttattgtattgggatgtgcttaaaggataaataggtttaccaaagtaaatgggagagtggcagcccctgtaaataagggcagcaaaattaaataataaaacactgtttggaggaaaccttgctgactggtttggaaaactgtctgggggatagtacaagggatgtttgaataggtagtagtaagcaagactgtagacagctgaacttgatcctataatcaacagtttacttccaaaggcttttgtataaggttataacatcatggaagtcttaagacgaatttggctattgaatataagatgaatttggctggacacggtggctcactcctgtaatcccagcacttttggaggccgaggcggatggatcacctaaggtcaggagttcaagaccagcctgaccaacatagtaaaaccccgtctctactaaaaatacaaaaattagccgggtgtggtggctcatgcctgtattcccagctactcagaaggctgagataggagaatagcttgaactcaggaggcagaggttgcagtgagctgaggtcgcaccattgcactccagcctgggcaacaagagcaaaacttcgtctcaaaaaaaaaaaaatgatttaaaaaggaacatactggagactggtgactagttaggaagttgttaccataatctagctggaaaataatactctgtcttgctcactctaccaccccgcctcccaccatctcaatctcttgtttgttctctcatccacatattttcttttattgtttcttcatctcttttaggtagtggaatattttttgatacctaaactcattaatgttttctttcacttctccttgcccttctagtaccaatggaacacattctattacttttataatttttaaaaatctgcttagttttgtcttctaacccttagttcacagtttaaaatttttgaagtactagaagttggaaagtaaaatgaactcagaaattaatgtgatctgctcctaggagaagtaggaaaataagaagaaacacttaattctaaagatagaggttctgaatcatgaatggatgaagttcacagaggagcaatgccatctcgtttctgaaaacaacctgatgatgaattaggctatattaactcaatataatctgacctaaaagaattctttgtaaatacctaggtgatgagatgatctctgcagcaaaccaccatggcacacatttacctatgtaacgaatctgcacatctgcacatgtaccctataacttaaaatacaaatgaaaattaaaaaagaattctttgtagattattttattcagttaccaatcttttacatttcagttgaggggacttagaagagggaaagatgtatgtccttacttctcagatcaattgccatttacttaagataaccagaaaagaaacaatataattaatatagcaatataaatggcaacaactccttaatttatattaatttataataagattcaaattataaaaaagaatgaaattatatcctttgcagcaaaggaggccattatcccaggtgaattaatggaggaacagaaaaccaagtaccacatcttctcacttataagtggagctaaacatcagatactcagggacataaagatgagaacaatggacactggggactacttagagtggggagggaggaggggaagagttaaaaaactgttagctgctctgcccagtacctggatagcaggatcagtcataccccaaacctcagctttatgcaatatacctaggtaacaaaccagcacatgtacctgctgaatctaaaataaaagtagaaaaagaaaaaaattaaaattaatatactaatgcaagatttctaggttggttatttaaacgtttataggaatatatatccaaaacatattttattcaggcatccatttatatacaatcaatatattagattctaattattcttatctactcattaagtgtcctaagggaccactactagtaacacttaacagcaagaaacattgtgaattaaactaatgcaactgttgcattaattaaactattttaacatttagacattttgtttttaataattcacatttttttcacactactaaaatgttattctctatataatatgtgttaacagataacattaagcagaaaaactgttagactatttaggtaaagataagtaaacttttcacatctgtcatacacagtttgaaaaagcattctggggaaaagaagggataagcttgaacatttttcatgaacatgtagttaacaaactatagaatataaaatcctgaatgatatagaaagccattttggtagtttacacctagaaaaaaatgtaatgtctttttgtcttggcagttaaattcattttgatatatttttgagctgattgtttttggtaggccaactaaagaacagagtaaacaaatttatggagcacagaaaacaatgtggtaaagaatgagagatgtattttcccatgaaagtccatttgagactcatgggttcctaaacgccgaccttcttcggatgttttaggatttaagtttgagaatgtctagccaattgcgattctgtgctttgaaggaagtaataagacttcatactgcctgtgaactctcaaaacattaatttgattaaccaattgatatgccacataaatatatttaaaatgccttaaaatacacattagctaaaaagtaacagataaacagatatactgtagatggtcacttaccaacttcaatcactttgaaaatacaaatgacacagatctaatttgcaggcaaatctctttcttttagttgtgccggtaaataggttaggattatgatcttcaatcctgttccaaatatctaccatatccaaagtttccctacttggtagctttggtcctaaattgtgatcagtgccctaccctggtgaactggattgggccacgtgtcaactgccagaaggctttttgcataggccataggcaggctacagctatatacacaaccgccagtctcctcttggccttctaaatgatgcctgtggtgaactttggcctgtgtttcctatggggagactactggttctctgtactgtactggctgtgtgcattccaggaaataaaaatagcagggcagtgtataatatagttttgaggtttactaagtaatacttcgcacaggagaaataatatggattttgtaatctgaccaacctaaattggaaacccaaatttgacaaatatgagctgtgttgtgtgacctcaggcacattgctgcaccactttgagtctcggtttcccgcctgtaaaatggccaaaagtatgcctacaaccctgctaggatgttttgcttttaaagtgctacaagagatgcgaagagatgggatatcttcctctggagattggaaagagttgatgtaatacagacctggttccaagatagggaaatttggcagctcttgttgagatgtagcctgaggataaattagaactattctaaacaagtggtttttaaataaatttaaggaaaatcaaataggacatagatcaggatataagtaagacttcaatggacttgagccagagagctctccagaagaagagtgaaagaacttcctgtaaggtcagtgtcagccatcctcaaggccaacccaagccaactgccatcactactcaatgtgcatttttaatgctatgctagttcctaaactgaagaaaaatttcagtaacattgaatgaaatattttctgtgttcctctaaatattatttttattaatgatgaaatatgtcaaatgcacaggatttcacatagcaaattctcgcatacctatcattctttcactaagttatgtcaaatctagcatgttaccttttctttaaatctattttcaagaataaaacgttacagacaaagctgaaacttcttatgtcccccccatgccattcttccctctttcaccctagatgtaagcaatatcctgaatttgatatttttctttgttttttattggttgcagacttttaataagttaactattattcctgttttcattgtgaacatttctgatatatgaatattttttttaacttttattgtaagttcaaaggtgcatgtgcaggtttgttacataggtaaagttgtgtcattggggtttgttgtacaaattatttcatcacccaaatattaagcccagtacccattatttttcttgatcctcttccttcttccaccctccactctctgataggccccagtgtatgttgttcccctctatatgtccatgtgttctcatcatttaactcccacttataagaaagaacatgtagtttttggttttctgttcctgcattagtttgcgaaggataattttcatttctatgtatgttttactgtttttacagcatccatataggttttcattaaacacatattcttcttcaatgttcttttgtctcttaactttatttctgtgatttaactatgctaatgggaggctctatttcattctgttaatatataaaatgaatctattggatgaaaatacaaatcttccattattggtggatatttagacttttcccagaatttaattttacaaacagtgcagcagtaaatattcttatgagtatttgtgtgtgagagagagttttttaaagtatacatctagaagtggaatttctgggtcgaagagcatgaatatcctcaactttactaggtattaccaaattgtttttcaaggcacacaaaattagacttctactagcagtatgtgaaattcctaattctctatatccgtatcgacatttagtgtggttaaatttttgccagtctgcacaatgctataggtccacactgatttaatttatattccactgattgcttgtgaggtaaagtactttttcacatgtctatcgtcaattcagattttcttgtctgagaattccctgtccatataatgtatttattttgctactttttagtcataagagtcttcttaaaaataatctttgccacctgtagttccagctactcaggaagctgaggcaggagaatcacttgaacccgggaagcggaggttgcagtgagccgagatcgcaccactgcactccagcctggcgccagagcgagactccgtctcaaaaaaaaaaaaaaaaaaaaagaaaaagaaaaagaaatctttgtcagttatggttatgatcctcataattatcttctccaaacttttgacttgggctttcagtttgtttcttatgcctttggcattgcatcaaatttacagattaatttgaatacaattcatattttcatgaagttcagtcttctaattcatgaacatactttatctctcctttcgttcaaatctttaatgtccttcaataacttttgctcactccataaaggtttcttgcagcttttactagatttattaggttctgtttcagccttcgttaatactgtaaatggaaccttgctttttttttcttattgaattctctaatttgttattactcatatagaagtttgttattggttttagtacattgattttctttccagaaaccttgctaaacattttgttagttcaaataatttgtactcacttggatttttctgtgtagacagttatatcctttgcaaatagtgacagttttgtctaatgctttccattttatatctgatttgttttccttgttttattgcattgtcttggaccttcattaaaatcttaaatagaaatgatgaaagtgggtgtttttgtcttgattttaatgggaagacttccaaaattacaccattgattattatgtttactgcaggtttttaatagataccctttaagaagttgagggactactgctatatttccaatttgctatgttttctaaaaaaggtttttaagtgtgatgaatttacttcatcacatttaaatgaacttcactgaagttgatttttgttaaatgctatttcttcatccattcaaatgacatatgttttcgcttttgttattttgttaattaagttaattacattaattaatttatttaattttgaagcagcctttcattttttggataaactcaacttggcctggatgtattatattttttacacattgctggatatggttcagtaatttcttttaaggatttttgcataaaattagtctgtaattatccttttccaaattgcccttgtcagatttttgtatcgtagttacacaagcctcagtgaatgagcggatagctttccttcttttttagcctctgaaatagtttatatagacaggggtttatttctcaaaaatctgataaatgttgcatttaaaattgtctgagctggtgagtgggagacttttgattatacatttcatttgtttaatggcaattgtttatttttcattctttaattttttccttggagtatgttagtgatttatatttctctagaaaattattccttttatctagtttttcaaatgcatttgcatgctattgtttatggtcttattttatgattttatcatttttgttgtatctttattttctcttgagtattagggttttttttttcctttgccttttctccttctttatttattggttttactggaggattgtttattttacaagcattttaaataaaccagatttttgttttatttttgctggttgtgctttcttttttctattgcactagtttctgtacttattttttactttttccttttcttttattcacatttagtctgatgttattttttccaactttttgagataaatatttaactcacttatctttccatctttaatgaataaaggcatttagtgttatacatttccctcattgtatacctttaggcatatcccacaaatgttggtatgtagtacttttgcaacctttacattctaattttttttaaattcccattgcaatttaattgttaacttatcaggtatttagcggtgctttaaaagttattatacaaggggtttgggactatcattttagtgttgatttcttagtgctcataattgtgttttaggtctcttaccaagagcttatgcctggttctcttttcttccccggtcactaatttcttacaaatctgtaaccttttttcagaaggcccaacatcaggactttgtattattcaccttgcctgcttcccagcacttttatcatggacacacctctggagctgacgtgggtaacaccgcatgcttctgaactcagaacccagcatgccatttgcttcactgcttcagctgcttcagactcttttctgtttctattctaaaaagatgttaaatcttgtctttgaaccgagctatattttttgctcttctccttttatacactatctttcatttctttgtatttagagtagaagaatgagttaatttgaatttctgtgtctcatagttttaaaacatgtacttctctgtgaagaggaagaactggagtagcaccctcacttcccagccaaaccgcacccccaccccagaaaaacacaatagtatgtatacatacatggtctcaattaatcctttattttgactacacaccctctttatgcaatattgaaaattcctctttgttttatggtcacacagtataatacttacaggaacattgccctctgtttttggacccttcagaggtgattattcccaaagaaaatgaatactacttttgccttgtattcgatattttcaatattactttttaaaatttcaattttccagtataaaactgaaggtcacactgcctgttgataactagcttgttcaagtaacagtgaaccataaggccaacagaattgattggaaattggcggcctctctgcattctaagcacttatccagagatttagtgagagctaatcacttcactgaaaaaacagataaaaatataaagatccgctttacattcagtaaagcatattgatagtaattagatgagaataataaagctaactaactgcattattctaagcatatcttattttattttatttttaaagatttgggaggtctaaatacagttctgttacatggataatattgtttaatggtaaagtctgggattttagtgtacacatcacctgaatagtgtacactgtacccaataggtagtatttgatgccttatccccttcccactatcccacattttggagtctccagcctttattattccacagtgtatgtccatgtgtattcattgtttagttcccacttataagtgagaatgtgtggtttttgactttctgtttctgaataatttcacttaagataatggcatccagttccgtccatgttgctgcaaattcactttttttatggctgagtagtgtttcagtaggggtgtgtgtgtgtgtgtgtggtgtgtgtgtgtgtgtgtgcatatgtatgtgtgtatatatatatatccagtcatccattgatggacacttaggttgattccatgactttgctattgtgaatagtgctgtgataaacatatgagtacaggtgtctttttgatataatgatattttttcctttgggtagatgtgcagtggtgggttgcttgattgaatggtagttacatgagaaatctccatactgttttccatagtggcagtactaatttatattcccacccacagtgtataagcattgccttttcttcacatctatgccaacatctattgttttttaactttttaataatggccattctggctggtgtaaagtgatattttattgtggtttaaatttacatttctgatgattaatgatgttgagcatttttttgtctgtttgttggccacatatacatcttcttttgaaaaatatctgttcatatcctttgcccactttttattggggttattttttttcttgttgagttgtttgtgttccttgtagatactggatattagccatttgttggatgcattgttcgcaaatattttcccctgtcctgtaggatgttaagaatattttaatggatagtaagagtctaggtcttagcctcagggaggcattgaagacttgtgtctcctctactagtgaccatgactgagagtagtggttacatgctttatactgaaccattcctgagtattctttccaccatggtcctgtccacagaagttttttttttttaagattcttctgtccttattcatgagtgcataaggagctcagtaaaattctctgcatgtcatcatctgtcatcatccaatgttactcttctgtagcattgtccttgttctctccagaatcttatctacctggttgacgcagagccataagatcttggctagtgtattagtccattctcacactgctataaagacttgagactgtgtaatttataaaggaaaaagttgtaattgacttacagttctgcatgactggggaggcctcacgaaacttataatcatcgtggaaggtggaggagaagcaaaggcacgtctcacatggcagcaggcgagagtgagtgtgtcagtgcaggaaaaactaccatttataaaatcatcagatctcatgagaattcactcactatcacaaaaatagcatgggagaaaccgcccccataatccaatcacttcccaccaggtatctccacaacacctggggatttaaattaagatgagatttgggtgagaacacaaagcctaaccatttcagcttgtcatctaaatttgaagtcagcaggggtctatgctgaaaacttagccaaatggtgtactccacagccttatacttgtggttttcagaactgatgtggccaaagcttagtggatcaccttgtttctttaatcctgtacttccgtaacccattatgcagaatatgtgatttgtaataaatttatatttaaacagatgattactgaacataagaaaagagaaatgaaaaagggttatgaactaaagttgtattttgagggggtgcacagaaaatatatacacaactaatgtagccctaagtttatcaaatataaaatcaattgtgcaacagctcatacctcagggggaaatattgtcttttttagtaagaactgccttgttctaaattaattaggctcgatgatgcttgcttgggctgctaaacacaaatttttcaaagaaatcttgtagtcataagaatgctcttaaagtagttcattatatatcatatttgaggctggagcttttagaacaccagactattaaagtttctaaaaccaaggatcaaactctacttacagtaatgattttgctacttagcccccacatgataatgccatctgaacctctgaggagttaaccttaagctagatcatatattccatatattttggcctgaaagtttttatattgttttcaaacaaattttatcgaaccctggtgcttatattttctgcttcttcacacttctgcttatttctttttccccatttgtgttgggacactagctgaggtaaatatacaggacttaaatttgtaaagttcaggttatatttctcttaaaactttagtttccttgaaaaacctatgtggatctttcagctaatgagtgtaaagtcactaagctctaaagctatgtcattctccttgtggataaacttattatttgactagtataaatgaggcacatattaatgtttcaatattcaggggtacgcttgatattgaacacaaggagttagcaacattcatttctagccaaataggtactcaacaaatatttgctgaatgaatggattgtcataaattcttctaaaacttgataaaacttcttcaactttttagtaccatatttgtcatcaccagagggaaaaagggataataatttctgacacttaaaagtattatgggacaacttagggcaggggtcagtaagctgcatccctcagctaaatgcagcctgctgcctatttctgtatggtttgtgagctaacaattgtttttacctttttaaattgttaaaacaaaaaatcaaagaaggacagtattttgtgatatgtgaaaattatgtgaaattccaattttactgcccataaaaaagctttattgcaacacaaccacattcattcgttcatttacacactgcttttgaaacacaaagacagagctgtatagttacaacagaggccatatgaaccagaaagcctaaaacatttactctgtggctcttcacagaaaaaaaaaatgtttgccagatcctgacttaaaagattcatgacatggttttcataaagaaacctactaggggaaaaacagtgctatataagtacaaaagtgttacaactatttcatttctaaatatgttgctattatttctgagctatttgcttgtgggccttataatggtaacaggtgctaatgcgcaagaataggatggtaactcctaccataattgtccacattcatagaaaactgcaggtatagctgcagccagatgtttaaagaatggaaattgaaatgaaaatgtaaaatctttactgaaaaaagggtagaaatgacacaggaattgcaccaatgacctgttaagaagcataggcaaaaaaaaaaaaaaaattgtctttaattcatgtgtgtaatccctgggatggatttctaatagacagcctcgcaaaaagttcacataatttgacaagaccataaaacagtttctcttttaaggcaaaaaaaacctaatttctttaaaattttcatagcatcaaccagtattaacaactagtcatatagaaaatgttggcaatttatttacaattataaagctttagtgagatgcttatatacctatggggtaagtgtgtatgtagagtgttaaatcaatgttagaagagggaaacgagtgaaataccaaattttgaataatgtaagtaaaatcacacaattttaagactatatccattttagggctaaaagcttacaacataggctgtgttgaaacagcacaaatggaagtgaagtttaattaatggagttcatttaactaatgtagacaataaaaccagatatttcactgcctgaatgggattacattttggcagttatatagttaatttgattcattgggatttgtaaattggatcattcagagtccaaagtgaaatggtgatttaaatgcagcccaatggcctttagagaaataatcaattcttcagaattcctctgaagaattaagttttatcctaattactcacctggaaaattaactcgaattttgaagcatttggctaggcaaaaataataataataataaaaataaacctgggccttccatttagaaaaaaaaaacatccaggaaaaaaactttgggaaagtttgagcccattaacatcaggcctgaaccctggtttcttgattttaaaaagtatcctataattatataggttcatggagttagcggatccattcacttgtttatttagtaaatatttataaaatcctactattgaatacatgccaagtacttttgaagccactgggaatacagaggtgaacaagttaacaagaaaaataggttccctgtcttcttggagctcacattcttgtggagaaaaatagatgataattgtgatttaaaaaataatttcaggtaggaaaaaattctatgtgataaacagagtaattagagggagactgagatgaggagcactactcctgctagtgtggatggagaaggccttcctgaggaggtggcttttgagctgagacctgaatgatgagaaagatgaatgttggggagatcttagagaagacacattcaaatacataacattaactctaacgtggaggcagagtccatcctagagactatttcattatgctcaacatcaaaactcaacctatattttctgaccaatactcagaaacatctttgagggacaattatgccatggacttattactatcattatttttgttatattgtaattaatattataattatccattgaagttaagagatattttcacacatattccattttaatctcatggagtgtgggtatattaatatccctactttgtagaaaagaagacttggggttcagggagatcgagtaatttgctcaaggccgcccagagaacagtttagtaattgtagagatagggccttgaagccagactttttttctaaatatccaaatggctcattttattacactattctatcttaaaccatactgtaattataagataaggttctgaataataattaatatccacaacagacaacatatttgtgtctacaataaagtaagactctttaatatctgctactttaggaaaagtattcagaatagaatttttagtctcaactttcatgatgggttatgatcaaaatagaggatgtgattgatttcatatagtttcacacatgatattcatatttggtgcttaaatatttaattttgtacattaaattttaaatatttaattaaatttatatttaatttttgcttcctctttttaaagcaattcagatttgtaaataacattgctgctgacttgtttttagaagagctgtcctttgaaaagaaaattagtcataatgtaaaattgcaattagatgggggtttgtttggtttgctttttgttctgttttggttataagcttttccagcactgatgttaaaatgctcacctgtgctagcctggacttgtgggatattcattgactttatgtccatagtaaagtagtgcagatcatcttatgtgcaaaacacatttggctaaggttgacaggattttcattttccattcacagatgtaaaacattttcagtataacacaaacctcagcataacaaactcagcaatttatgagaagcacacagctctgcttacctttcatttgtcaaagattgatgagaaacatctatattacttgttcaatctgttaattatatgttttcatccaacctgaactgataagctaagatctgtccgctcatattagtctgtagggatatgcttgtcaataaggcctttaaacttccttacatgtgacctataactcaagtaattctttataaagcaatatttgaaaagttatctatactttaagattacacttacggtacccctagatgaaaaataaggtacaaacttcaaagactgcagtttcataatctctaaggtccataatttaattttagatgacttaatattaactttgaggaaggagttaggaaatttaaaaatattatgcttgcttttaattaatttttagcttttaattaatttttaagttactcaaattctacaaatattttggggaagtttgcataactaatatagtgagttttagagatttcctctccaagtaggacctcaaaaatgcttccaaaataaacattttaatgtcataaattttttaattcaacatagtataaaaaacataaaaatggagttgatggctcttggtctcagtgtggcaatgtaaccaaaaactaaacaaatgctctcaagccaaatcattatggtaaagtttaacatctgagctccatgaacctatttgttggatcatcaaacatatgttggaatgatcaaattcattgtcctagcactggtcataatctgaatatcttcagcacaattcactgccttgaatcattctggttttaagttaagcatagaaaacagatatcattaactttaaattatctgagttcttatggtttaaagcaaaactttgagttttctcttgactattttaaagttaactaatactgaatttgatccttgcttttttaaatttaatttttttattaaactttaacttctgtgatacatctgcagaaagtgcaggtttgttacataggtatacacgtgccacagtggtttgctgcacccatcaacccatcctctacattaggtatttctcctaatgctatcccttccctagcccccaacccctgataggctccggtgtgtgatgttcccctccctgtgtccatgtgttctcattgttcattttccacttatgagtaagaacatgcagtatttggttttctgttcctgtgttagtttgctgagaatgatggtttcagcttcatccatgtccctgcaaagacaagaattcatcctttttatggctgcctagtattccatggtgtagatgtgccacattttctttatccagtctatcattgatgggcatttgggttggttccaagtctttgctattgtgaacagtgctgcaataaacatacatgtgcatgtgtcattatagtacaatgaattataatcctttgggtatataccccgtaatgggattgctgggtcaaatgatgtttctggttctagatccttgaggaatctccatactgccttccacaatggttgaactaatttatactcccaccaacagtgtaaaagcgttcctatttctccatatcctctccagcatctgttatcttgtaaatttctttatcttccttgtagattttgcatattagccctttgtcagatggaaagattacaaaaattttctcccattctgtaggttgcctgttcactctgatgatagtttattttgctgtacggaagctctttagtttaattagatcccatttgtcagttttgacttttgttgtcattccttttggtgtcttagccatgaagtctttgcccatgcctatgtcctgaatggtattgcctatgttttcttctagggtttttatggttttaggtcttacatttaagtctttaatccatcttgagttaagttttgtatgaggtgtaaggaaggggcccagtttcagttttctgcctatggctagccagttttcccaacaccatttattaaatagggaatcctttccccattgcttgtttttgtcaggtctgtcaaagatcagattgttgtagatgtgtggcgttatttctgaggcctctgttctgttccattggtctatatatttgttttggtaccagtaccatgctgttttggttactgtagccttgtagtataatttgaggtcgggtaatgtgatgcctccagctttattccttttgcttaggattgtcttggctatacaggctcttttttggttccatgtgaaatttaaagtagttttttctaattatgtgaagaaaatcagtggtagcttgatggggatagtattgaatctgtaaattactttgggcagtatggccattttgaagacattaattcttcctatccatgaacatggaatgttttttcatttgattgtgtcctatcttatttccttgagcagtggtttgtagttctccttgaagaggtccttcacgtcccttgtaagttgtattcctaggtattttattctctttgtagcaattgcaaatgggagttcactcatgatttagctctctgtttgtctattattggcatacaggaatgcttgtgatttttgcacattgattttgtatcctgagactttgatgaagttgcttatcaacttaaggagattttgggctgagacgatggggttttctaaatataccatcatgtcatctgcaaacagagacaatttgacttcctctcttcctatttgaataccctttatttctttctcttgcctggttgccctggccagaacttccaatactaagttgaatagctttaaaaccatggtgatgttgatgttcttcacacacatctgcccttgtttcttttaggcactagcaacaaatggaattttcaagagatttttatatacatcacaaggtagataaaaaaaaatttttggaggagctatttgtaaagctcaaatgcagaaaaacacaaattttagaacattcaaactaaaaagacagtggactatgagctccttgagaggagtatttctactccttagctctaggtctagtgtataacagatgcttagtaaacaaatgatgagtaagtaaccagtataactttttaattttactatttttgaaaccgaggcccaaaggagttaaataattctatgtggttgcacgaactaatggcagaagagaaataagagaattctggtctcttgaatctcattctacgcaatgccctttcctctataatactatgtttcttctaatttatttatgttgtttcctcaatcctcatttccaatgacttgggttgagtaggtgaattttttttaggctatgttccaatatcaggtttcactctcacaacacagaaagcataggcactaaactaatgcatgtacattatccttttaaggttaataacgattcttccaaaagcagatcagttcttatttgctgtcactaccataggttgaatctcagcagtgacaaccaatactaatgtacaacataaccttttctcattaaagaggtagtgggaaacataggtgcaagaacattttcttactaaattatcaagttgagttactcactcttgtatatatatctgcttctgtgacatactgcatgatccttcaagaagtgtcatcctattgatacgctgggagaggggtttcacaagagttgccagataaaatataggatgcccagttacatttcaaccctagataaacagttaaattttttttagtataaataggtcacaaatgggacttatttgctaaatctggcaaccctaggttatttgtcatgcctaaacacccaaggatgtcccaatctgctgacagcctgctcttcattgcttgattttagtagttgtgattgctttgctcaccaaccactttactgtgtgtagtgaatcttcagagcattattgtgggccagttgctaatgctggcaatttacatgacctgttaacagattagtgatgcaggcataaacagaatcccttccccagagtcttatgggagctgggaccaagccttccaccttatttgtcatcatattcaaacacatatctctttttgatatacataaaagcttatgtccctgaactccattgagagtgttattttctgtagcttctttatgaaaatatatcttttccattttacaaatataaaattatattatgatagtaagcatgctttttcaagctacacttcatataacactactctaaagattttgaaatccatctcttgagaataaggcccccaactgagaatcagtggtctatgagataccaaaacaaatcaatgagaagtcaagtactcaatcaagctactaatttttcaattacttaaatatattttttttctaaatcagtgttactcaaagagtgactttttatgtaacaaaggttaaataataataacataattatgttaatgtttatttaaaatattggtttttctattctgttttagtgattaaaaatttcagtttggaatccactggtttacctaaaagtaaagaaatagttagcttttaaagaatctattaacttccaattccctatcccctctaagttgaccagccatttggactttttctgcgtaagcagaagactactgcatttaaagatgacaggctacatacaaatctgaaaagctttttattgttgtccacaattgttacattataatatcttgcatttgttttcatatatccattcaacatggggatataattatattattcccatctagcagatgaggaagctaaaactcacagtgaagagatgcctcgttacactattgaggattagattataatctttattgtaaatcttagcttgtttttagttttattgaattagtttttataattacattattgcatatttctgtgcctcaggagtctattgatatatgaactattaggtttaaaggaggaaggttttatgagaagatgaatatccagataattatagccctaaaaaagaagcttagatagatgtgttaattctgcttataggtatttgtttaatttttatccaaataacggtttagcatcattccaagagatatttaacaaaaatgttttctattgtatcatccacttgtggattaagcttgctgagatgttgtagtagtccagagtttacacacttaatctggttaggctgttgcctgccaattaactgtagtttattgactcttttcaagttggataacacagtgactcagaaatctttaccccctgatttaattaacctgtaataaatattaaactgatttctgagattatcacattttactcaaatgcgaactatcatttgtcatatccagtcatatccagtcttcttaaatgaaggaaaacacaaattacataggtaattttttggcagaagagtatgaaaacaccattttactatttaattcagcacccaatattagcacttcatgttaacaaaaggcagaaatgaataattaggatcttccatggttactataatataaattatacattttaaggttattgcagattaaaatattcagtactgattactattaaaattaaatactaagatatttatcagattcactttaaaatgcatagtctatcttgaaacaaaatttctgcagcaataaaatttagataaaatgtcaaaaatcctaacttaaagcaatcgttttgtagttaatcttcatgtatgattgcccatcccaatttgcctagacattctgatttttgacaatcagtatagtcttctctgtttatcctcataaaatgtctaacagggttatgagctgctttggagatgaggacaatgaaatgcagaaaaaataagtaacttcacaaaggaccttcataaagcttcttcctcagccaacactagatagaactgtagctattgaacattttggagctctgtttttctgatggcaaaaccattcataggaaaagtgaaacactgctgttacctaagcataatgcccaacttttaggcactttaaaaacatctggttgattattttcacttgtaaatcagatagttgacaaccttgtatacttgtgtatatatttacagaaagttagaatgccctgttactcaaccgactagatactgaattacctcaagtaatacccttgaattgttttaatattatatacatacattcttggtattgtgctatatcagcgttttcatgtttccttccattagccttcatttaaattgattttaagtataacaaaagctaattcacattaaatgtagtgcgcatttgatttggagtgagttttttttacaaatattattattatgctatcctatgaatatctaagtcatttccaactggatatagaaattattaaggtatatattaaatgaaacactttagttattagaaactatagaactgtctctgggtatggtggtttgattaaattattacaattatataatgcttttattctaaagtacgatgctaaatatatttaacttgaatgtctacttcagtactttaaagttctaaggagtcaattcgcttctaagcgtgtagtctcattttagtgtttgaaagtgggtaagaatctgttcttgtttctttttttaagttttcttattttactttactttaaattccaggatacatgtgcagaatgagcaagtgttttacataggtatacatgtgccatggtggtttgctgtacctatcaatccgtcatgtaggttttaagccccacatgcattaggtatttctcctaatgctctccttccccatggctcccaccccacgacaggccctggtgtgtgctgttcctctagctgtgtccatgtgttgtcattgttcaactcccacttatgagtgagaacatgtggtgtttcgttttctgttcctgtgttagtttgctgaggatgatggcttccagtttcatccatgtccctgcaaaggacatgatctcattctttttattggctgcatagtattccatggtgtatatgtaccacatttttttccagtctatcataggtgggcatttgggttggttccatgtctttgctattgtaaatagtgctgcaataaacatacgtgtgcatgtgtctttgtagtagaataatttatattcttttgggtatatacccagtaattggattgctgggtcaaatgatattcctggttctagatccctgaggaatcgccacgctgtcttccacggtggttaaactaatttacattccaatcaacagtgtaaaagcattcctatttctccacagcctcacgagcatctgttgtttcttgactttttaataattgccattctgactggcatgagatgttatctggttgtggttttaatttgcatttctctagtgaccagtgatgatgagctttttttcatatgtctgttgttggcaacataaatgtcttcttttgagaagtgtctgctcatatcctttgcccactttttgatggggttgtttgtttcttctggcaaatttgtttacaaatttgttgtagattctggatattagacctttgtcagataggtagattgcaaaaattttctcccattctgtaggtttcctgttcactctgatgatagtttcttttgctgtgcagaagctctctagtttaattagatccatttgtcaattttggcttttgttgcactagcttttggtgtttttgtcatgaagtctttgcccatgcccatgtcctgattggtattacctacgttttcttctagggtttttatggttttgggttttacatttaactcttaaatccatctcgagttaatctttgtataaggggtaaggaaggggtccagtttcagttttctgcatttggctagccagttttcctagcaccatttattgaatggggaatcctttcccaattgcttgtttttgtcaggtttgtagaagatcagatggttgtagatgtgtggtgttatttctgaggtatctgttctgttccattggcctatatgtctgtttgggtaccagtaccatgctgttttggtaactgtaaccttgtagtataatttgaagttaggtagtgtgatacctgcagctttgttctttttgcttaggattgtcttggctatatggcctctttttcggttccacatgtaatttaaaatgtttttttttttttttttagacggagtcttgctctgttgcccagcctggagtgcagtggcgcgatctcggctccctgcaagctccacctcccaggttcatgccattctcctgcctcagcctcctgagtagctgggactacaggcacccgccaccgcgcccagctaattttttgtatttttagtagagacagtgtttcatcgtgttagccaggatggtctcgatctcctgacctcatgatccgcccgtctcggcctcccaaagtgctgtgattacaggcttgagccactgcgcccggcctgtttttttttttttctaattctgtgaagaatgtcaatggtagtttgatgggaatagcactgaatctaaaaattactttgggcagtatggccattttcaagatattgattcttcctatccctgagaatggaatgtttttctatttgtttgtgtcctctcttatttccttgagcagtagtttgtagttctccatgaagagatccttcatgtcccttgttagctgtattcctaggtattatattttctttgtagcagttgtgaatgggagttcactcatgatttggctctctgcttgtctattgttggtgtataggaatgcttgtgatttttgcacattggttttatattttgagactttgctgaagttgcttatcagcttatggagttttgaagctgagatgatggggtttttaaaatatagaatcatgtcatttgcaaacaatttgacttcctcgcttcctatttgaatacccttcatttctttctcttgcctgattgccctagccagaacttccattactgtgttgaataggactggtgcaagagggcatccttgtcttgtgccagtttttaaagggaatgcctccagcttttgcccattcagtatgaaattggctatgggtttgtcatgaatggctcttattattttgagatatgttccatcaatacccagtttattgagagtttttaacatgaagggatgttgaattttattgaaggccttttctgcatctattgagataatcatgtggtttttgtcattagttctgtttatgtgatggattacattgattgatttgtatatgttgaaccagccttgcaacccagggatgaagctgacttgatagtgttggataagctttttgatgtgctgctggattcagtttgccagtattttattgaggattttcaaatcaatgttcatcagggatattggcctgaagttttctttttttgttgtatctctgtctggttttggtatcaggatgatgctggcctcatacaatgagttagggaggtgtctctccttttcaatggtttggaatagtttcagaaggaatggtaccagctcctctttgtacctctggtagaacttggccgtgaatccatctcctgggaattttttgattgacaggctattaattactgcctcaatttcagaacttgatattggtctattcagggattcaacttcttccttgtttagtcttgggagggtatgtgtatccaggaatttatccatttattctagcttttgtagtttatttgtgtagagttgtttttagtattctctaatggtagtttgtatttctgtgggggcagtggtgaaatcccctttatcattttttattgtgtctatctgactcttctctctttccttatttattagtctagctagtggtctatttttttttttccggaaaaaaaaaaaaaacagctcctggatttattgattttttgaagggttttttgtgtctctgtctccttcagttctgcactgatcttagttatttcttgtcttctactagcttttggatctgttttctcttgcttctctagctcttttaattgtgatgttagggtgtcgacttcagatctttctagctttctgatgtgggcctttagtgctataactttccctcttaacactgcgttagctgtgtcctagagattctggtacattgtctttttgttctcattggtttcaaagaacttcttgatttctgccttaattttgttatttacccaggagtcattcaggagccggttgttcaatttccagtgagttgtgttgtattagtgagtttctggatcctgagttctaatttgtttgcactgtggtctgagagactgtttcttatgatttcagttcttttgcacttgctgaggagtgttttacttccaattacgtggttggttttccaataagtgccatgtggcactgagaagaatgtatattttgttgatttggggtgaagaattctgaacatgtctattaggtccacttgatccacagctaagttcaagtcctgaatatccttgttaattttctgtcttgttgatatgtctaatattgacaacggagtgttaaagtccttcactgttattgtgtaggagtctaagtctctttgtaggtctctaaaaacttgttttattaatctgggtactcctgtattgggtgcatatatatttaggatagttagctcttcttcttgaattgatccctttatgattatataatgcccttttttgtctttttgattttttttttcgtttaacatttgttttattagagactaggattgcaacccctgctcttttttgctttccatttgctgggtaaatttttctccatccctttattttaagcctatatgtgtctttgcatgtgagattggtctcctgaatacagcacaccaatgggtcttgactctttatcctatttgccagtctgtgtcttttaattggggaatttagtccatttaaatttaaggttaatattgttatatatgaatttgttcttgtcatcatgatgctagctggttattttgcacactagttgatgcagtttcttcacaacatcattggtctttatattttggtgtgtttttgcagtggctggtactggtttttcctttctgtatttagtgcttccttcaggagctcttgcaaggcaggcctggtggtgatgaaatcccttagcatttgcttgtctggaaagtattttatttctccttcacttatgaagcttagtctggctggatatcaaattctggattgaaaattctttaagaatgttgaatattggcccccactctcttctggcttgtagggtttctgctgagaggtctgctgttattctgatgggcttccctttataggtgacctggcttttctctctggctgcctttaacattttttccccttcatttcaaccttggaaaatctgaagattacgtgtcttggggttgatcttctcttggagtatcttagtggtgttctctgtatttcctgaatttgaatgttggcctgtcttgctaggttggggaagttctcctggacaatatcctgaagtgtgttttccaacttggttccattctcccagtctgtttcagatactccaatcaattgtaggttcggtctttttacatagtccatgtttctcagaggttttttttttttctcgttcctttttattcttttttctctaatgttgtctgcgtgccttatttcagcaagatagtcttcaaactctgatatcctttcttccacttgatcagtccggctattgatacttgtgtgtgcttcacgaagttcttgtgctgcatttttcagctccatcaggtcatttatattcctctctaaactggtttttctagttagcagctctgtaactttttattaaggtttttagcttctttgcattgggttagaacattctcctttagctcagtggagtttgttattacccaccttctgaagcctacttctttcgatttatccatctcattctctgtccagttctacacctttgctggaggggtgttgcaatcatttggaggagaagaggcattctggcttttggaaatttcagcatttttacactggtttttcctcatctttgtggatgtatctacctttgatctttgaggctgatgacctttggatgggtttttttgttggggggaggttcttttgtgttgacattgttgctgtttttacttcctgtttgttagtttttcttctaacagtcaagccccccttctgcaggtctgctacaatttgctgggtgtccactcgagaccctgttcgtctggctattaccagtggaggctacagaatagcaaagattgtggtctgctcttacctttggaagctttgtttcagaggggcaccagcctgatgccaaccagagttctcctgtatgaagtgtctgttgacccctgttgggaagtctctctcaatcaggaggcatggggccagggacccacttgaggaggctgtttgtcccttagcactgtgctgggagaatcccccttgtcaggatcagccgcactcttcagagtcaggcaggaaagattaagtctgctgaacctgtgactgcaggcttccctccccacaggtgctctgtcccaggtaggtgagagttctgtctgtaagcccctcactggagctgctggatttcctgcagagatgccctgcctaatgagggggaatctagagaagcagtctggccacagctgctttgctgcactgtggtgaattccacccagtccaaacctcccagtctccttagcactgtcaggggaaaaccacctactaaagctacaataatggtggtcacccctctccctaccaaactcgattgccccaggccaacttcagactgctctgctggcagtgagaatctcagtccagtggttctcagcttgctaagctccgtgggagtcagacccactgagcaagaccgcttggctccctggtttcagccccctttccaggggagtgggcggttctcctgtctcactggagttccaggagctgctggagtatgagaaaactcctgcagcctagtgcctgcctgaaaagccacccagttttgtgctcaaaacctggggctctagtggtataggctcacaagggaatctcttgatctgcagattgcaaaaatccgtgggaaaagtgtagtaccctgggtaggtggcacagtcacttaatagcttcccttggctgggggaaggaggccccctggctccgtgcacttcccaggtgaagcgacgtcccatcctgcttctgctcgctctccatgggtcgcacccactgtctaacaagtcgcaatgagataaactgggtacctcagttggaaatgcagaaatcacccgcctctgcattggtctcactgggagctgctggagctgtttccattcagccatcttggcccctcccccttagtttctatcattggaatattgcattatttttccttgaaagttttcttgaacatgtagagcaaacaaaccctagactctactagtggaacattgatcaaaatatgtttcatagagatgttccttaaacaaacaaaatacacacacacacacacacacacacacacacacacacaaccaagtcaggtcaaaagattgtttaatacactggggaaatactgcacacttaaggttgtgtctcttgcagaattccaatgcataatagtttattagaggctctgaaaagctcttcaataaagaaagctgtttatttaatccatgatttcccaaactgatttggccatagaattatttgtgtgtgtgtgtgtgtgtgtgtgtgtgtgtgtgtgtgtgtatgtatacatcttttagcatcctgaagaattagtattatgtggagcacacttttgataatgctggtctaatttctttcagactgaattttgaatagaaatttagttttctggaaagaggataaggtcaagaggcaggagaccaaaaggcacatatttgctgagtaattaagtcagtaagtgagtgagtgaattaatgagtcatggtttctgttctgtcactaacttgctctagtatcctgagccagtcgtttcaatatttgattattaaacgttcttgtgtaaaagcatgtaagattacttgccctaattacttagtagatgttgaaaaataatagaaattaaagtattttgaaagcaaaagtaattaaaaaagaaaaaaacatagaaaatgttttgctctttttatatacagaactatttagaggagaaatatgatgatgtcttggagttactttaaaatacattagctaaaatataaatgaagcaaatttaacaaaatattaataattaaacaatatagttgataggtatatgtgtgtttattctgctattctatttctatgtatgtttgaaattattcaaagtaaaaagttttaaaaattcaaaaaagtattatgctgtttgtatgtaaagttgcaattactaatacagacgttgattttatagaacagtgtatgggattgcaaagaagcatgattattttgtcatcttgtcctccctgtaaccaagggcagacatttgttgaactgtcatgtctggttagggtggttacctcagaattttcctttgtgtaatatctgctggctaaaataagatttgaacttgaaacctagggttcattatgaccgtgccctgacatagtaattcccaaagcgtgttctgtggacccatagcaacaacattacttggaacttgtcaaaatgaaaatccacaggctctatctcatgcttactgaatcagaaatgctcggagtgggttccagtaacctgtgttgtaacaaggctgccagatgattttgatgcttgttcagatttgagaatcacctgttgtgttgatctacaacacaagactgaagtgcaatatgaaaactctatttccgtcattactcattagtattgtggtgtcatacattccataaagtcttaattctataatagaaaacagtaaacaggaattctattattgattaacttaacatctttctccatcgttagatgattgtttacacaggttgagtagatggagttaggacctgagaacgtgtgtgtgtactgtgttaatgacctgagaaccctgatgcatgtcacaatggcccgacccactcaaggcatgcttactggatggaaagagaagttttcattgtgcagatgtatttagacacatcattccagttgttgatgtcttattatcttggttttgtgacaaggatattctatccccatgcctgaagcatgtttaaaagcacacaagttactggagcacagtgcttgggttcagttgccatttaactagtagctggtcactgaggtggaacggcccctttcaaatttggtaaaaagaaaaaaaaacccatagccatgaggttgaggcttctaaaagttataaagcagcccacaaactctttccccttgaggctttatgttagaggtggctaacatcttatatcttgaaaataaaattcttaatcaagcttcttcagagaaatccataaagctttgtactctactattaacttattgaattggagaagaatcatttctataccggtggaaattgatgaggaaatggaaatatggggacctttctctaattgaatagttggcattatgtatgtattctaaattcagagtaatatagccctttattcttacatttttaaatgaagaggaccattttgttgatcatatttcactttttaagataacacttgccaaaagttcttccctaatgtttatggaaaggaggatcaggcatagcatcacaggtaatttcctcaaactttttcctacttctctagtcccacttaaagatggcagaagcttttgcttctgtagagaccatggccatttctaatactgacatctgtagtgtgagatccactggcactgctctgctggaaaattgagggcatgttttaaccttttacagtcaatcagtattgcactaggttttgctatctataatgttccttttcctgcctacttctaatttgttcaattctagagcaattaaggactgcaaaaatttctgaatcccatttaacaaatcccatggaacagttgagaaggcaatttataaagtagtgaggagtaaaaccaggagacccttggtttgtaaaggctggacccattcctgggtctttatctggcagttgctgtagcagcatatagtgaggaggaaaagctgagggaacaagtcttatggaagcagtccattttattattttgcttgattttttcctaaatctatatgaaacattttagctgaaacccatctgacaaaggcttgattttgtgtgtcaaatgtacagcaataaatgttgaagctgtttttatattggggactctgggcaggaaactgggctgtcattctaggacaggttaaaggcaagtctgtgatggaaaagggcaaggttcaggaaactcaggagtaacaagacacttttgagttttggctgaagcaggaaacgaccctagataactcacagggagagaaagtgtcttagaggacaggtctgattgaaggcctttatatacacaacccaaggtctcctctgttggctccagaaggtgtcatctacttctttcagtattaaaagaaatttaccgagtttggaccttgaataaaaacatacttatggagctccttgctctctaggaaagaagataggcattctatagcagttacaatcatagcgaaagaccagggtgctataggagcccaattgtgaagcactatgcaattgaaactctcattcattcactaaacaaacattttaacaacatactgtataccaactacattccaggcactaggtgctgagaatgtagcagtgaataaaaaagacatgactcttgctttcctggggcttataatccaagaaggaataaacttaaacatttatactccctatttgtgatcagttgagtcattctggaatcatataaactttcatgacaggaggtagggcctcatcttttgacctgacttgatcttgtgtgtgtgtgtgtgtgtgtgtgtgtgtgtgtgtgtgtgtgtgtgtgatctctctagacagatggactggaggtagagagagctgtgtgtgtgtgtgtgtgtgtgtgtgtgtgtgtgtgtatctatctatagtttgttatagcagttagtactactgttgtactagaggtagagagaggtgtatatatacaacaaagaatcctcaaatcacagtggctaaatacaatgaaagtttatagtccaatgtgtattggactattaggaataaacaggggttgagggattctgctctgcattcatgcctcccattttgacacatagccttttcctactctgcattgttacatatccttttatggacatattttatctccataactaagtttctagcctcctctagattcttagacctctttgtttccctagtgactatcatgtctgttgaagataactttctagatttgtgtacattattaaatcaaataatggagtagattcaaaatgagtagaattatagatggttaaagcagagaaaagaacttagagattgtttagtttcaagtaccttgttttacagatgaggaaactgaaatctggaaaatagtcctaaagtctatcatttctctcagtgaatctcacctaactcagtcaaccaagtggaggccctatctcatatagaaagggcgctgccagaccagaggagttaatagctaataaatcatagtatgtcctgctttctattaccttgtaagttagaatagaggggcattttagctaattcacattattcacttttctggtgcttggactctcttatttcataaacttatctgtaaatggattatttcaactatatagcagaatttgaaaagaatcaaagttattaaaaaaaaaacaaggtcacccatacaattatgagatgtctggagtatagtcttttaggatactgagtaagcccttggcaggtttattatgagccaagtcttctctggaatttaatcaatgcactaatttgaattggaacaaatgggaaaaaaaaacaaaggaggctttcttttcaattcaattcaaagtaaattgtattccagagaagtcagtctctggttggaattggaagcctctggtggccttaaaagctagaaacatgagtctcaacctcatgtaatgaggagctcaagatgagtttaggaaggattttatttcagaagatatctcttgaatgactaggcttgctggccagaaaaaaagccagttggttgcaacaagttcaacatgtacgtggtcatttcttattgtatgtaaaaaaccagactcactcagggtttagaattttccatgcagtttagcattctgtgcataaaaataaagacatgttttgatatgaagacaagcatcttctgctcatgccagaatctaacttaacatgcattaacatgtctcctttcatatttataatgtttgcattttagaaacatgagcctcctaaaggaattctggaaatataaatcctataaaacaatgtaactttccttggttcatttactggcttgtctatcctgacataaatagaaagacggccccagtgttcagggacttctgttactctcagccatgagtttcaggtgaacgttcaagtttctatattttacttgctctacgtcagatagtattttcaattattaaaaccataatcctgaagacaagcatactttttgtagcttacttgtaaatttgtaattttaacaacttagtttatgctgaacatgaataataaactatcacctattaaacctagagagcaccagaagttactaatatgatttacaatgcactgcaaaaatgggattcattattatctcacactttaaaaatttgcagtagagtagtgtaaacaagtatttactttaattaaagaaataacaagggttttgtagggctgtattttatgtaaaaaataagtatccaataaccagaaagttcatacttgttaaaaagaatgtcgtgcattaactgaatcttaccagaaaatctgctcatctgtttgaaagacaataaggtgtttctaaaagcttatctacacactgctgatggcccttttcagttcttgccagcaattcctgtctttaaagcaaggtcagtgggagggcctttactcaagggaaagagaatttgaagtatccatgttacttttcttttctttccttaaattgcctttgtagagcaagacatttattagtgggccttgacagatccttgagacttacaaaatcaccggtagaaggataataggctaactttagatcatgttcaaactcctcagctggtaatcacttagcaaccccctccccatgtaatctgagtccatcatactatctatgcttgtctctcactgtgctccagatagtaacatctgcttttgctgatgtttggtttaaaaatgtattttaggacagctcctatttcatttgaattagactctttgtcaagtctgcttttattagttaatcacgtcagattcctctaccctacatagatgatccctcacggaaatttaacttgttcttcaagcccaggttcatccctacttccttccatgaagcccttgtcaagtaatctagtacatgctgatttctacacatttgaatatccatactatttataatgtatctgtgcttgcgtatctcatatgtaggaatactattctttaatagtcttacataaaatgtataacctgttaattataatataaaacatttacattttaatatgaacacacatactagaaccagaattaatagagttaagacattttcttctagggaagctattattgatttgaaagatgcttctcctgctctagaattttgggtgaatgttttcagaaaaaaagtcatctaatttcttcatgccacatcatgtttttgttcccaaatgaatttatccggattgatatcgcacttcatttgacctagttaattccaacttatttttttcagtatttataaaatttaaattcaacctcaaagaaagattcctcctagtgaataggctaaaagtgtgtttcagatttagaacacaattactaaagaagaattccagaaatgtttgcaagtgtaataagtgcatggtttcctaattgactaaagatgatccttattcattgtataaatttgtctatactgttaacagtaaatctatgattactatgttcacatgaggcatatattgaagtatacatccaagtcttattgctttaacaagaatgcaagctcacacctcaaccagacatttaacctcaggaaagttacttaaatactctgcctcatttttcccataagtcaaatgattttagtaatgcctatctcataggatgctgtgtagagtaaatgagagtacatgaaaatcagttatacactgagcttgccatgtggtaaatactcagtaaacattagctgctatcatcgttaatactattatcattgtttttttttttttagaaatacttgttcaccttcttttcttaaatgctgttgtcgaattttatattttgaattctagtcttcttatattcaggtgaccatgcatagccctcccgctaaaattatcttcatctgtttttgagcttactccttttcttgaaacctctcagtggctcccctttcaattttattttaacgtcaatctccttgaatccaatttcaatgcatatattctattacattccttgaagtcagggactatacttctttatggtatcaagtatcatgtaaatttcattaataaataacaacaatatcatagctacataaaaagaaactagtggcaatctgagagacacttaggggaaatccttgtgggaaatccttttttttttttttttttctctaaaatgaaactctccattttgaagccacacactgataggccataatgcggaatcacacatgaagcaattggaaaactcatcttttctgaaatgaatatggacaactgatgttgttaataagcaaatgcaaggatcattgccttgaccttctatataggtgaaaacaatggtttaggaaatgaaggctttccagggtggtgtaaagaatagtcagaggttgttctacttgaacaaccttactatccatgttgaaaatgggataagggagcaatcagatctaaagtggaaaattacagcccaatttgtgttcaggtctcctctgtgtctccttttggtgtccagagccactgcctcacaccagcccaaaatgtaccagggaatgagagactttggcatttgagagggtacacaatctaagttcttatcgttcacttgacctaaattaatggcagcattaatgatgaaagcacaccagtaatgttaaagcacattaaactgagatcttttgtctctgcagagtaatgttctgttttgagatttctcattatgcaaagtaatgaaacagccaaatcactatgtacatctgtgtttgtcgatacttgacatttggttttaaagtgaggtttaggaggacccttatttaatctgggttggactcttctgtgatccaatttatttgctgccatttggatttcatttctgtagttgagcatccagttgccccaatataaatttaaaaggccctcttcctttaattaattatacttactatattctgtaccataattcagctcattcactttgaagagttggaatgaacagtatctcagggccatagacatggcactctcaactaaagctgtgctttggaggaatattggaatacagttgtaattgctattggctcaaattcaaatttcttaattgggcattctaggccttccataatctggccctgatttgccttatcctttcataaaatctcttgtacgtcccctgaacatggtagtagcctaataaatcagttatattcttccttctcccaggccttccccattgtactttagtcaagctgatgtcttcaccgtcttttaaagtctactgaaatctcaccctttctttggaagttttccttgtgctatagcatccacttcgctttctctcttttctttaatttctttggggctaagtgctagatgctggtactagttgataaatgtttcacatgggtagatcttttcaacaagattatgatggccaagtgggcaaggactgcattctcttgatgtatatcctccatagtgtctgacacagtgctaagcttataaaaaacacttactgatctatgctcaagaggttgattagcctgctgtaccttcgaaattgcttatttgatgagtatatattgcctaccatgagggagattctgaggatgtggaaattttatgatgaataaaatatagggttgaatttcatttgaagctgcaattatattattctgggtggataaaagtgtgtgtgtgtgtgtgtgtgtgtggtttttttttttttagtcatatgtcttttagctgtaatggaatcagtaaatcccctcctgatttaacatggaatctgttggtaagcagctgctgggtttctaatcctgaaatccagaaaataaaattggactttcaactggaatatctatttttaggagtgctgtattagacaaacgttttcctatgaaccactcagaacccaactacatctgtaagttagttgctaacatagggcaacctcaattaattacggttttgtgtcatgaaaatattttcagggacttaggagtgtttgcaaaaagctaggtcagaaagttaatgtgaagaaggattaaagaatttgaaagatcaggcacctattagatgattatagtacttcaggattataacttggattttctaaagaatatgcacaattctcagatttcactattaaaagtccacttattggtttaaaataaaaaccttccataagtagattttccagaagagcatttcataaattttctttattatttcacttagcttaaaaagtataaagtgcacatatttcaacttggattttttcaagaaagaatagtgttctctttggttttttttccttccaaatgagtaacaacttagtctatgaaaggttatttgtgatgtttctatgaaaactgtaggtattttaaagaaaaataaaattcagaaacccaggtcagcaaattgaaagtattgggaaactttttttcaaaaggaacttaaatatgcttataacagcactacatgttttccttctatggttagtgctcaaatatttccttttaaaattaacatacatactactttgatgataataacaacaatctgtactcaccttcttcaaggcatatgatttattattgtagtagtgggactgaattgctgatgcattcatatactccccttggtgaaaaattcgatgcatacgtgtagcatctggcagaagttaggggcttagtttgtagccaacaaatagaaaaatgctaaatgtcccaatcctgtgttgttggcctaaataggagcagcattgtgccttgaaaaattctatgctaggactcaggaaacttggattctaactgtgtgaacttctggaaattcatgcattcatttattaaattaatatttattgaactaagaacaaggcactgggctgggtattgaggcagtagaatacaatagacaagattcctgccatgatggaacttacagtctagtggtaaagacagacagtattaaaataattacacatataaactgtattattatacctgtggtacgtacatggaagggaagatacagcgctatataaaagcatataatatgaggatttgacatagttaggaaggtcagaacctacttccctgaggaaattatgattagtaaactaagcaaaggaggagggacagtgttctaggaaaaagagaagcatgtacaaaggccctgtggtgtgagggagcttgatgagtttaaaggattgcaagcaaggcagaatggttagagtagaaggagtggagaggcaaatggcacaagtgaggctgcaggcatcaacaggggctagattgtatagggcctttacgaacattaaaagagtttgccctttatcctaagatcagtgggaagcctttgtagagtttcaagcagagaaatgatggataagatttgaattttgaaaagataactctgactacagtatgaaaagcaaatcagaaagtgtccagagaaggatggagatcacttatgagactgtggcagtcattcaggaacgtgatggtggcaggttgaacaaggatagtggcagtgaagagaagtggaaagattcaatagagaagatatgaaattggaggagcctagactcgatgcagaggtgatcaagagggcactgtcaaggataactcatagatttcaggctcatttaactgggtagatggtgtgtcattccttgaaatgaagaacactatagaactgcgattgttttgtcacggccaggagggtaacagaggtcatgaatttctttatcagatatgttgagtttcagttatttttaacttgtttggacctcagtttcctaatctataagataaggacaatgaacctctgagatctcttctagagcagggcttggcaaacttcttttgtaaagggaaggatagtatttttagttttgtggactgaaactacttcactcagctgttatagctggactaaagcattgaacctcagttatccagatatagcaatccttagaccatgtcaacacaaacctgccaattgatttggtcaattgccaaaaaaaaaaaaaaaaaaaaaagtcagtcaattaaatgaagaattgattgtgtcatgagttaatgagtcaaatcagtaaaattagttgatatagtagacttgagggggatatacctatatgtattatgattacagtagaccctgccaccaacaaaagggatgacaatcaggagaatatggctgacccacccatggaaaagctgagtaaagcaaatcagaaaaatcatcatgaaaatagggctatactaagcacttactatttgagtagaagttactgttattgctgatgttgcctcctgttagtcatggatgttgccactatcactgtcttgaggcatcaagtatgactagtgggacagcccagtaatggagatgctgtgtgtgtgtatttgtgtgtgtgtgtatttgtgtgtgtgtgtgtgtgcatgcacacgtatgcatttagggaaataaaattatatagtaaatattataatctacttttttcacttaatgaatgttttggacatttactaattttgttaactttttgttgagattatacttaatcttaactttgtgggtggtctgtatttaattctcatttgtctttggccttgtcacctaatatttctctgaagtagcttcctctcatcctcagttggtatatattttgcctatagcactcctcaatgaatattcgtgcgggggtagggtagaagcatcttataatgtacttctaaagctcagtacatatagggtttgaataatatgctgttttggatgaaatgattttctactcctcaacattaatagggataatcaggggttaaccatgtttgaacatgacttatataataagtatgcaaaatgaggcttctgagtatatagactacggcaattgggtgaataattgactatctcaggaaaaagtaaaaattttaatcgaatcatacccataattcattcttataaaatactagctcatttccattcttttcagcttgttatgaatgaatataagaaaactaagctttaaagccaaagatattcttcatgaaattctttccatttgagacaggtagattgacatttccatgatttatttaatgagataccttctctcccatgctatattattgttatttaatatttattgaacactctaaccggagatggttggaggggagaagcagagagtttgtcaagtcttagcttacactggttatgagcagaagttttagctatagcactgaatcaaagccactagtcttgtctatttagagaccaagggagagctttctcgttggccctctgaaagtttgctgaaaatcactaacaagaggcatattaattggagaaaatgcatacaaatgtatttaatatgtatatatggcagccttcagaatgaagacccaaagatacagagcacactctccagttcaatgaaggataaatagccatgtatatatataacttgacaataaaagaatatgatacaatgctaatagaaatagagcagggaagcccagcatggtctgtctgtccagattcttcttgtcctctttgagcatgcattctttccttctgggtattgggcaggtccttccctggaatgagggtcttataacctacggtcaaccgagataggtcagataatttcttcatagccagtttttacacagaaaggaagagggaaagttacaataacacatttaggttttatggctggctttggagaaagggggttattgtttctctgacctgccttggagaacaggggttctagtttctatgactagtcttcggggagaatgggactaagagacaggagggcaggagaaggtcagagagaagcttttgcttatgaggctgcttctgaggccttcattttggggtgttgttttctgatccccaacactatcatgatgaaacatgaccagcaataggggagcccaaactaagagtggacaaaatctggaagccagaaagagggctaggcagagcattacaaagatccaggacagtcttggcagtggggagcaggaggaagtttagacctgtgattatcctcaaggaagcccagcagtaaattaaaaacctagtaagcatgttgagcatgcttcagggaaggccagtagcagatattcaggtattttggtagtcagtaaatgtcaggtctagctctgtcaggagatgatggggcctgaggtttggagcctgatttcccttccttagaaggacttttgtgagtgtgttaccctaggcttggaggaatgatagatttaagcaagggatttacaaagaggcaaggtaaggagttggttcctggaactgggatcaaggatgggacttaattttaaaggaacaatggtgaaatactaatagaggttataggctcagaacaagtctagcagcaaagctgatttgatgtcagacaattgagtcacttataccctttatattattctacttgcctaattcgttggtcctagagtcccaggttcaggaatgggggtgggagcattgaagataaatgtggggttaatgacacgactgcttatattagaagaatatggagtaaaaaaattaagtatcctatcattatcagagcaggaaaagtagtacaaattccccttttttgcatcatcatttggctgaaaattataatagaaatgtagtcctgagaaccacttgctacatgaattttaattttctcttctctctctctctgtctctctctgtctctctgtctctctctgtctctctccctctctcccccactccccgacacacacacatcccactcacactcacaaatacatggatccacaagaagggcatagctagcctttagtgtacatggccttatctgtggtgtgatgtgcttgcctcaaccttagcagtctcccactatgaacattacaaaatccctctactggctactcctcttttaagaagagatggttgctgcatggtttgtttggaggaaatatgtttcagagaagacacagaggagtagaaagtatcagtgtgtccagggctggtcctatatgaagctcctaagtaagagtaaaatctacctttgcctttctctcatatcacctttcaatctccttctccccaacatggcaggatatcagattaagttcagattcatctgttcaacaacaaatgcacaatcatatggcttcagtctgtctataggaaatctgaggttctcttcaggcacctaattcttctctgtctctgagtaaggttaaaaattaatttattcctgttcatggccttagtgactagcacagtgtctgtcataggcactcaagggagtttgctacttaagtgagtaaatgttgttcccttgctactcaaagttgccgaccatggagtgctacctaggctagaatacctgagctcctccctagcctcactcacattaaattgtatcttttctacattagatgtcctcagcgccttatttctgctggacaatcgataaattaatcctgataggatgatagcagcagattaattactgagagtatgttaatgtgtcatccctcctatataacgtatttgcattttaatggagcaattctggagataatccctgaaggcaaaggaatgaatcttgagggtgagaaagccagaatcagtgtccagctgcagttgtgggagaaggtgatattatgtatgtctcagaagtgacaccatatgggcacctgcctactccacctatgtgttatgccagctttgatgaataatttttaaaaaccagaattattatttattgctgttcttttttagtgttattttagatttgttgattctctagagcaaaacctcaagccctttggggcaaaaacaaatggctaagcctaataagatgcatggtgctgaaaataagattaattatctaggatttgaattgaaattgtttttgagataaaatatgtccaaaatgtattattatgaaatgtttgtttgcagtgcttacagtatgccacactgaatgtagttcttattttcaagctgggaaggggagcaaataatatgatatctcaggagaggaaaaaaaaaatctcactttgtacccttttctaatccagaaggcctcagtttaactcaccatggtataccccattttagtcaaatgtttctttaagaggtctataagaaatatattaccagagtattttaaaaattttagcaagttcaactttctgagacatacgcacatagtcagcttttatacaaaagtgatatatttttagttccatgaaactagattattttcaagtaacgagatgatgccatttatcacagatacttaatgaaagagctgccaaatgctttattgccatagtgtgaatgcttaagttagtcatttattcaacaaatgttttacgaacacaaagtatacaccagaaactgtgaaaagtacaatgggaatgtgaaagttattaataaataaatatatctcatatgtctcatatatcatcaagccagatcagaggtttcagatacttttttttttttcctgcagaagacttctttttgaaactgcttccatttggtttcactgatctatttatcttttattacaccaataccacactttctcgattactgacattttgtaataagtcttaaaatcaggtagtgtaaatccttcaatattattctttgtcaagattttttgggtgtttcaagccgtttgcttttgtacctaaattttagaatcagcttgtcagtttctacaaaggaagcattctgtaatttttattaggatggcaatttggggacaattgacctcttaatgttgaatattccaatccatgaccatggtgtatttgtccatttaactagatcttacttaatttttctctgtaatatttcatattttttagcattgaggtctttgcagttttgttaattctttaaaaatattttatgctttttgatgctataattggcatttttaattttattttccagttgtttattgctaataaatagaaatacaacagattttcatatattgatcatgaatcctctggccttcccaattagttctagtagctaattctcaacatcttaggattctctatataaatagttgtgccatttgcaaataatggcagctttatttccttcttaaaaatctgtattgcttttatttcctttgctcaccttattgtgtggtctggaacatctagtacaatattgaatagaagcggtgaaccagatagcccttccttgtttctgatgttagggaaaaaatttttagtctttcattattcagtatgatgttaactataagtttttaaatagcctttacaggttaaggaagttccctttttttcccaggtagctgaaaggttttttgttgttgttgtattcataaatgggtgttaaattttgtcaaatgtttttctgtacttattgaggtgatcatataatattttttcttttatcctctccataacgtgaatggcattgattgctttttgaatgttgtaccaacttttcattcctgggctaaaccgtatttggttatgatttagtacccttttttatatgttactccataacatttgataatagtgtattaatgatttttcctatatttatgacagatattggtatacaattatttttcttgtgatgtctttgttaaatttgggtatcagggttatactggtctggtgaaataatctgcaaatatttccttctccgttattttctgaaacagtgtaagaacttttaaaatgtctgatagaattgaccagtgaaattctctagttcaaaagttcccttttggatttggtttgaaaattacaaattcaatgtctttaatagatacggggtaactagattttatatagcttcttgtgccagttctgtcaattttagaagaatttatcaattccatctatgatgttgaatttattgctacaaagttgttcctaaatgtttaaaggttctttagcaatgtctccattttcattcctgatatttcttccactttatttggtggtagttagaaattggtcaagcctgaataatgtataactatgaatgtatcctattttagtttccatagccagcacttcttaatctcaaggtatttatttctctctcccctctataatcactgctctgtctttcccgaattactacaaaaggcttaataccttttttgtgtataaactacttttattttatttactgatttttgttaccaataagaagcaatctattatcttgtacttgactccaaaaatacctaacacctttcaactctggtaaaatgcagtaatattcagattatttgaagaacaagtaagaaccaggtatcaatgtaaatgcttgacttaataatctagagttcaaggtttagatgtgttctaaaatcctgaggagtgaaacgttaaagtagctaagaagcataaaatctcagctggatttgaagatagtcccaaaccacattttaaaggtaaaaaattttgtaatcacacacacacacacacacacacacacacacacacacacacaaaatgcagaacatgtggtcaatatatgtcatccatagtgtcaacatcttaactggtctcattatactgtattttcacttggtcctttcttgtgtgtttctatttggtccttttaacacacagatttgtttcaacttagttttaaactatagtttatttattttttctttacttatcattgtatcataaacatgttttcaagtttctacatatttttctttgccttcactttaagtgatgacataatattcagtttagtggctgtaataacatataactatttccctactttgacccaatagatttttcctatttttcaattctctgaaacaaggctgagatgaacatattcatatatgtaacttttccccgtattttgtattacttaattagggtagatttatagaagtcagattataacctgaaattaaagaggaaagccatatatatttttataatttggctaaccacagagactttgtgatcatgaacttattggaattctttacatattgagtatggtgattagtattgttattatgggatctcaatttagcatacaaaaataaattattgagagctaaaggtaagacatattctggcagaaacataggaaaactccgagcacgccagagaccatggatgtataaggaacccagggataggtgaaggatgtggtgaaggaatggtggtgcaggcgtatgcagttaattccagtgaccagggtaaagtcatatagcatcttaagaagtcctacttctgaccaagcatggtggagcatgcctgtaatcccagcactttgggaggccgaggcaggcggatcaccttaggtcaggatttcaagaccaacctggccaacatggtgaaaccctgtctctactaaaaatacaaaaattagccggatgtggtggcttgcacctgtaatcccagctactcaggaggctgaggcaggagaattgcttggacccgggaggtgaaggttgcagtgagctgagatcgcaccactgcaccccagcctgggcgacagagtaagactccatctcaaacaaacaaacaaacaaacaaacaaaaaagaagtcctacttctgagagatctgagacacatccacgggaaagcccttgttccatagaaaagtcattttaaatattaagttttctataagaaatcaaggctgcaaataatatgattggttctaaggttgttgtgcaatacattgtgctgtattcagagggaatcatggccagtatttcataagaaatgctcacctcaaagagagtgttctatgattacctaaaccttaggatagcggccttcatgcttgaaagagttaaagggtctttcagcttcttcctcagcatacagtttaattgttatatgaaagtagcaactttcattttttaataagaggagaaaacttgatcatcatgcttgaaaattttgtgaaaacagttcaagtgtatatgctgtgataccattgtctagcccctcccaaagccattacatattttaatattttatttttactgattgaaaggtcttgggatcaaggatgagggaatacagaaaatagaatatgaaataatttcttaagataattctgatttcgaatagacctattattactattattatttcaaataaataatagtgaacacctctccttatatttccctgtgtgtcagcttgtacaccattctttctaacttacgttttatcagttagacattgcaaacttttaatgaccagattttgtctcccccaccaccaactggcactgcagttcacgacagttgatgtgccacgtttaatttttgccggtttttaaaatgaagtttgagcgtgatgttgtgtagaaatgtcagagctactgacttgtcagcctcattatgctgtgccccagtgactgcttcccaaacattaattacattgcacagagaccatgtctattgtttttagttttttttcccttaaactgtgaactctaaattgatttataaatcaaatgcagctgattagtgtttataatgttttcttaaatgcactttgaggtacaggttacatattatataaaacactgaccccactgccaaaagataacccacacctagttgattttctgtgacaagtagtttgtaaatgattaccgctcatgctacatttgtcagcttatgtgtattccgatgtcaggataccctaaagatataaatgactacttatcgctcaacatagtggatattacccatgtgttagtcatacttgcctgggaataagtgctttaaggtgacactgcatcaaagaaagttatagtgggcctagagggtgattcaaagatctgtgtctttgtatttttaaataaatttagcaagattgaaggatcaggtgctctgcttaatcaaagagtatgctttgcatcacttccaaggagtaagaatttagtgaactatagttaaatgtaaaactacagtgaatggattatagtctttctttgaatcttcagaaggcacttccagtttgtgctgttaagcagggtcatcattagcaataattattagagtattggctgaatccccagtcaatagatatttcttgatgacagaatgccagaacactgagggttgactgtaattcatatgctttgttgacgacgaaagggtcagagttagttacttcggacatttttaacctttgatatttgaaacaaacaccaaataggactcagtgaacaagaaaattcaagaaataccaattcttgtttagcaacttgaagccagaagcttctccagcactcctacaatgttggcagagtgggaaggagccctagctttgtatcagtgaaacctattagaggaattttatatataaggacatgaatactacaattaataggaaattccaaattcttattctattcaatagtgttaatcacatgttccagctaccagtgatataacactgattctatccaaggctgaggaggagagagaatttatcattgttagcttctatctagaaatgagctcaattctcttcacttaatgttaaatccacagaagccattccataaagatttaggccaattctgtctctgccctgaaggtcaaagaatcaggctcagtaagaactcaaccccataaaatcagtgattgctggaatcactttgactttgggagaacaaaggaaagcactctccagtcagaagatatcttccttaatggtctactatgggacctaaaagttcaaaactaaaaattaatacctttagacaaagacgctgaatttccagatgacctctgtaaaaaattaacttgttctgggagagataacccgtttcgtcccaattagtcattaatcattaatcatcttgaataaagtgttgacaggtagacatctagaaaagacatgagagaaaaggatgtagacagatcaagtaaccttggatgaaagagaagaatagatttggagtggtaataaagggaaggcactatactagaatattttattcagtctggaagcaacaagaagccactgataattctgaagaggtaagagaaagggatttcttgtatgtgtatgtatatgcgtgcacacacatgcatacatgcatgattgtgagagagactgaaggtggtgatatcagacaaaaccttttctggttattggttataacctatgataattagtaaattattattgaatagcattgttatttactttttattattggaaattccttcttttattttaatgtgattatatatctgtccttcaaatcttcatatcacttattgcccgggcacagtggttcatgcttgtaatctttgggaggcggaggcaggcagatcacttgaggacaggagttcgagaccagcctggccaacatagcgaaaccccgtctctactaaaaatacaaaaaattagctgggcatggtggcacatgcctgtaatcccagctactcaggaggctgaggcacaagaattgctttagcctgggagactgaggttgcagtgaacccagattataccactgcactccagcctgggtgacagagcaagactctgtctcaaaaaacaaacaacaacaaaaaaacttcatatcacttcttgcatacactatccttttgtcaaaattttgttacggtttcaggagtctgattcagtgagggcctattatgtgttggccaagtttgggttggtcactttctctaccagatcaacttattcatgattcaagaaatgtgtctatatatggtatacttcaagcagcgtgctagtcactttatttacttccaagatatatggaattaagtaagctacttattctctctaagcctctgttttctcaccaacaataggaagaagaggatgataatgttaatgatcgcaacaatggcagcgaacaatgaggaagtgagtgcttattgtgtgctccacactagagtaggaacttaacatagattactttaaaatagtatgtgtatttctttttcattgcaatgttagaatgtgttcattgtctaaaaaaaaaagacagtaaaaagagaacaataaaaaaactacctttagtgccaccatctaataatctacctaagaattctactatctgaccattgttaatactttggtgatatatgtactttcaaactttttgctacaaaagacatacaacatgtgtttttgttaattctcacatcaacattgcaaggtagatattgttattctagaagaggaaacatgaggttaagtgaatggaggaactggtagtagaaccgagctcactctggactcaaaagatttctccaatattctgcttctcattcttctgtaatagaagtgtttagggactgatactccttttagccaactaaacatctgcaattagaatgaagtaaaaaatatttcttccctcatacaaaccaacttcctagtaggagtcattggcatgtaaggcaagatttactaaatgaataagattgagaatatcaactggaggaccaagtcatctgaaatgacagtgatatttctaaaataaaaggcccatgtctctcacaaagttcacctctcacttaaatatgaggttttcattctaagttagtatttttcctgagagtgtctattgagctggtagcaaaggttcttgtagcagcaaagtaaattttatatcattaaaaatctacagagatgtcttcttcaaataccccatggtgccctgctctctggcatctcccttccctgctggataagaggtagacactcttgcgaagattagatcttttgggctaaactagggtcagctggaggggttggtttacaaccccctagggtaaaaagtgcaaagatattattctgcataggagaacttagttgcttttgtggaacatttttagttcacttggttgcttcctgtttttgctttttttttttttttttttttcacattttcttttatgtattaagatgcatagtggagtctaatttcaaaaactacttagtacatttttttagagttaactctggaaaagttagcacgtagatgcacaacactttaccttttcgggcaatacttccattgttttacacgtagagaaaatgggcttctaatgagagagagaagcttaaagaaaaaaaaatgcttaaaatggtatgaacccagtattcaccttagacaaaatcacgctaccacacgctgctatgtctggggcagacattctctcatttcctgcattttttttttttttttttttttttattatactctaagttttagggtacatgtgcacgttgtgcaggttagttacatatgtatacatgtgccatgctggtgcgctgcacctgtttttgcttttattttctttcccagaggttattttcattctctgaaattataaaaccatattctccaaccagggataaacctaagactcaatggcatctccactttccctgggctgatagggaatctagatgacaacctagagtccttcttcacagtagataatctggagagtttgtacccacaaatgggtcaaacatattgcattcagtgttccattaagtcatgccaagtccacgctcccatgggtttagatttcaaaagaaagggctaggaggttgtgcatttcctggcatggggtatacctcttagtggaatgaaagacactttgcagacaaaaagctggcatgaaacatacctttgattccaccaacaagcatgccatatgtcacaaaattctactgcttcctccctgttatttcatctgagtgcctctttcctgcacatggctctcgggtgcagttaagtaaaatggatagtacatttaattgatgtaactaacttgaattcagttgggcttaagttagttatttgataaatgggtagtatctagagtttgatactctttatgggaggcaacatgatatagtgaaaagagtgccagaataggagtaataaaaccggggtttttgcccaaggtctgctattgccttgctttgtgacctttggcaaatatctgagcctctgttttctcatctgaaagtcagagtaataatatttttctgatctgctatgtcagcggggtatcaggcatataaattataatattgtgtgtgaaagttcaatattggaaaaagtctaaagtgctttgcaaagtacaaggtactattaatatatactttctaatgaatggctgaataccacacatctatatgaacatggataggaagaacagagcggaaagtacaaatttcaaattttccatccaaaacttttataattgctattttatgataaaaaacaatacatcttcaatgtggagaataggaaaaatgtaaagaaaataaaaatcattcataatcacccaacacaaagattattgctatttaaatattttggtgcatttctcttcagtattttttttcaaatgattggcaataagccctgtctgtgagggatttttctatttttctgatcacaaattctaaacagtttattatagagaatttaatagaaagttaaccccttcttcctatgaaactaatattaacattttttcatttttaaatttagtttcattattaaatacataattttcattattaaatttatcatattttttatttaaaattgttttctagtgttttcctacatcatcagatactatccaaaactattttaactttttattttctatattttaaaatatacaagtggcccttggcttatgacctttaaacttacatttttcagctttacaatgggtttatcagggtattaaatgcattttcgacttatggtatttttgacagatgatgggtttatcgtgagttaaccccattatatgttaaagagcatctgtataccaaagtaaagcacacaattagatgaacccagcgcttatcagtcatataacttggatgattttcaactcataaaccatattgctgcacctacaagccactcaactcccctttctttcctccatgacttttttttattattaaagatggggtcttgctatcttggccaggctggtctcaaactcctggcttcaagcgatccttccatcttggcatcccaaagtgctaggattataagtgtgagccaccaagcccagcctcttccatgaatttttgaagtaaatccaagatataatttcatccataaaactttagcatgtgataacaaggtataaaaactttctttaacctaactacaataccatattgcacattaaaaatgaacaataaatctttaatatctttagatatcctgtacattcccatttccccaaatgatctcataaatatgtgtatagtattttcatttctttgttgaaatgaaaacccaaagaagatgcacacattacaatttgttagtatgtctcttaaatctcttttatgatcctcatatttcccttccttcttttattttttcttttcaattatttgtttaaaaactcggccattttttcctatggattttctcacattctgtattttgctatttctatccccactgcattatttgatatgtttctccatctccagtacttcctgtaagctggctatgagacctagtttactgctgcctaatggaaatacaatctgagacctatatgtaatttaaaattttctagaagtcacatgaaattaatttaaaaaatatattttacttaacagaatattcaaaatattataacaatatataatcaaaataaaattattaatgaaacattttacatttttttactaagtctttgaaatcttaagcaaaaaaatccccaatgtatagcacttctataaaatcctgccattaaaacatcagttatttgggcagaacttctgactgtagtctaatgagataatctacaatgaccttccccaaaacaattatgaagctcaacgaattgacaaaaacgacacttaagtacccggaaatcaaccaaaggcctacaacaatccaagaagcatttgtatttcaataaactattggactgtgggtaataaaagtgggaatctatgatgattaggcctgggactgctcatgatccccaccttcaactctgagcttggccaatgccaaggttctgctgtggtggggcaggctgtaagaattgtagctgcattggcatggttgaaaatggttcacttgtgaagaggtgaatgatgcccacacccagtgccattgttggtagatgttacagtctcaaacttgggccggtggggaaggctagcagttctgctaacctgaggttgtggttgtgactgggaaaagcatgtttctgactgaggctgagcttatgtgcagcagacaatggagaactacctgagagggcttaagccagccacacactgctagtcaacacagtggagacatgaaaagccctgtggataataaaagctgcagggcaaatatgaagatggcatcaacattgagtgagctctcattcccacacacagatccattgtcggagaatagaacacatacctgctcaagatgggtgagcacaacctctgcgcaatcattgaccagccacaatgctacaaggacacaggagtgacccgtaggaaaccagacttaaaaagaatgtgacagaaaaattgacaaaggaaatcagcagctacataccatagagtgacatatttcacagatatagcccaggcaagtgactacataaagaaactaatggacaaaatgtaacaataaccttcagggagaaaaaatcagaatccagagctgctatactatattatctaaaatgtccagttttcaacattaaaaaacactatgatatatgcaaataaacagaagagtataactcatcctcagtaaaaccacaaaaaagtcaatataaactgtcgctgagtgtctccagcttttgcaattagcagacaaatcttcaaagcaactattatacatatgttcagactagtaaaataaaccatcaataaaggcttaatggaaagtatgacaaaaatgaccaaattgttgattttcaagaaagaagtagaaattatgaaaagacttaactggaaattctaggattcaaaagtatcataatttaaatgaaaaattcactagagagactcaaaagcagatcgaatatggcaaaagagacaatcagctgacttgaagattgatctgtagatattatccaatctgaaaaacagagaggaaaaagatctctctctctctctctctctctctctctctctctctctctctctctctctctctcacacacacacacacacacacacacacactaaacagagcctcaaagatgtgtgggacaacatcaagcatatcaacacatgcataatgtgagtcccagaaggtgacagagaaaggggcagaataacacaacatgtaaaaaggaatatattcagaaatttaaaaggacatgaaatactgatacacactacaatatggataaacctcaagagcattgtgaaagaagccaagtggaagagaccatatattgtatgacttaatttaatttacagaaaatgtccataacaggcagattcatagagacagaaagtagattagtggtcgccaggggttgggaaagaagggatattgggaatgactgcttactagatttaggaattatttttagggtgatggaaatgtttcaaatatggatggtggtaacggtttcacaactctgtaaatgaaccccgaatcattgaattttacacttaaaatgggtgaattgtatttatgaaaattaaactcaataatgctatttagaaaaacaaacagtaaacatatcaacaacaaaaacaaagcaacaagttcagtaatttgatctagtacttagttattctggtatggcccacaacatctggcataaacattgactccctgaatgatattttctcaaaacaacagacagcctagttttgatacatttacaatcacaaaaggtattagtaatcataactgtataaaatgccttacggtttacatggccttttcatgtgtattcttttatttgagtcatctgccagcactctgagggagaaagggcatttaatctttagtatgaaaaaggaagggaagttaactgatttatccaatggcatacagtacgtgacacaatgggcccaagctcagacttcctgactccaagttcaatgtcctttctgctacattatgccaaccctactctctatggtagcaacccatttgcaattacattgtactatgccatgtaggtgaatatgaaaatatggatattagaagagggaatcacaaaggagaaaattacagttctatttgtgctatgttcttcctgaatatttgctggtagggaggctgaggaagtcagcaaatttcctgcttgtggcctggaatggcgtggagatctgtatcaaactgattacacattgacccaacaacatcaagtcaattctagccctctttcatctggttatgtagtaagtgagaaatagggtaggtagggggaattgtgttatagactgacacctaataaccttgcagagcagccatgtcttcatagcttttctggtttcattcatagcatcttaggatcttaggatgctatgaatgaaactggatatagattcccttttttctgggcctcgttatgccattcttatccaagaagcttattttctttgttatataagcaaggccaaatactttttcagatgctctgtaggatctaaagtcttcttagtctctttccaaactgcacctgaaagtcttacttgagtttcctacagtgattcctccagcttcctttgaaccttatttcagagattctgtgactgccacatagcaaagaaattaagagtacaggctctggagccagaactttcggatttaaattctagctccactagctgtgtgatcttggtgaaattagttaacctctctgtgcttctgtttcctcatctgtaaaataaggaaacatattataacatttttgaggattaaatgtgattatggatgaaagttgcttaaaagagtacctgtatcttctttctagttcttttaattttgataaaaataatgattagttataattaatattaactaagtatagtattaaataatattactaattattatttgtagtagtatttaagaaagctgacaactttaacctataccagaagttttcctctggtacttgtattttttaaaacttccagtctaattattctcatgtgctagccatgacaaccctgtgagattcataaaaataatgatagtaggtatttccccactttacagatatgaaataaaggaatgctattttgtcataaagttgggtctagagcttccttttagaacccttatatacagatctttctaatacagtctgctgcctttggcatagttatcatttgcccaccacagcaaaatatttggtacaagtcccgacaatcattgttaacctctgtatccacctctgcgattaagtcactaaagggtgtgtatctttgttgaatatgttatgttaatttgattagctccttttcagtctagtctttagcataattgaaaatgagtctccagtagtaagcagtagaaatgctactgcttccagttgttatacatgaaacttgaggaggttacagatacagtgttgatttcactaagctaatgctgaagacgaatggcagtagaaagctatgattaatacttgctatttggaaactctagaagaaagttatatctttggttgtataagaccatatttaaagcctattacttttcaagatactgtattaaatttgatattacattttgcataagtactttaatgctaaaattactataaaatttacaaaaccccaatggatttcattgtagaaaaatgaattgaatatgattgtttatttgtggaaataagcagctattgttcttctctaaagagtaaaaaagcttttatacatcgagttaccttcagtttccttgaagattgtttcctatatgaagtgtttaggtgatctacataatccaccacaaaggatattgagaagtaataagaaaaagataatttgaaattactttagaaggtgctggagttccaaaagaaagggtgtgatggagatggatattactgcaactcagaactgtatattatttgcaaattactaagggatagaaatatgctaggtatttacaccgttacaaaaaatttctgctccaatgaatttgagatatgaaccagagttcctgggcccgcattttgggaggcactaagctgttgccatttatctaatgggatcatatgaaatactcaataaatcttcaaaattattttatatatatatatagtgtcagtccctgagaattttgttcagacgtgtgtgtgtggtatctatggggtacatttggagtcaagattccctaagcagcaatggtaaatactaaatgagagtaagcctccaaaataatttgtgttagagcttctttatggaaatcagtggcaccaccaacttttccattcactaattttttacctctccacttgtctcatgtgatccaacattggtgtccatgaaaagttttgaggctttaacaaaaataatgagaaaaataaagacacattcattcagaaaaatcaagaatctacaaaaagagatgtgagatcatcgctatttaattgtagaattaagcaacttccatgtttctcttttaaagtgtcctaaagagcctgccaaaacaccttgaggatatggactgcaggtgtttttgcaattgagtcaaatcagttttgaaggaatatttttgcaggatggaccttttattattccattgtaatagttttaaaatgttaatagaacaggtagattaaacaaatacatgtaaactaatgccattgttatggtttgaatgtgtcctccaaagtttatgtgttggaaacttaatgtccaaagtaacagtgttgagaggtgggaacttcaacagatgaataggaaatgagggctctgctgccatcaatggattaatgccattatgatgagcgtgggttcattatcaagagagtgggtctgttgtaaaagcaactttgatgccttcttgctctcttatgctttcttgctttattattattagtagtagtagtggtagtattattatactttgagttctgggatacatgtgcagaacattcaggtttgctacataggtatacatgtgccatggtggcacccatcaactcatcatctacatcaggtatttccctcccctattctcccactcccccgacaggtcccagtgtgtgatgttcccctccctgtgtccatgtgttctcattgtccaattcccacttatgagtgagaacacgcagtgtttggttatctgttcctgtgttagtttgctgagaatgatggtttccagcttcatccatgtccctgcaaaggacatgaactcatccttttttatgataagcaacttcagcaacgtctcaggatacaaaatcaatgtgcaaaaatcacaagcattcctatatgccaataatagagagccaaatcatgagagatctcccattcacaattgctacaaagagaataaaatacctaggaatacaacttacaagggatgtgaaggacctcttcaaggagaattacaaaccactgctcaaggaaataagagaggacacaaacaaatggaaaaacattccatgctcatggatacgaagaatcaatgtcatggaaatggccataccgcccaaagtaatttagagattcagtgctatccccatcaagctaccattgactttcttcacagaattagaaaaaaactactttaaatttcttatggaaccaaaaaagatcccgtatagccaagacaatcctaagcaaaaagacaaaactggaggtatcatgctacctgacttcaaactatactacaaggctacagtatccaaaacagcatggtactggtaccaaaacaaatatatagaccaatggaacagaacagagacctcagaaataatgctacacatctacaaccatctgatctttgacaaacctgacaaaaacaagcagtggggaaacgattccctatttaataaatggtattgggaaaactggctagccataggcagaaaactgaaactggaccccttccttacaccttatacaaaaattaactcaagatggctttcttgctttcctaccttctatcatgaattgacacagcaagaaagctctaactagttgtgtccccttgacctggactttccagtgtccagaactgtaagaaataaatctcttttctttataaattagcccgtctcaggtattctgttatatcaacacaaaacaaactaagatggcacaaaacaaactaagatagcagtaaataatttcagttcaactcttgagtgttatctctttgacataatagaatgtctatgtaccatgcaagcagtctactttgaaagccatcattttctggagaagaagtcccatattcagtacataaaattctcagcccatctcctaaaaagtggtgatttacttctctttttatatactaaaatgttatggctgtttccacgtgaaaccaaaagaactgaccaattccatgataaaatcagactagtcctttaagctttatatgcttatgtaagctgtcatcacacacaaactgatgtgttctttttcagtgttagaattcaatcaaactataattcattttctgactaactaaatgaagtcaatcaagcagccactgaataattagactaacaaattgtttttggaaaaactcttggttttacaaagttttgtcatatttttctaaagcaacttgtttatgtccagttggtgaccatgttttccttttagagtaacattcatcaacaaaaagaacaaaaatgaaaatggcaaacagactgtgaaagatagtttcaacaaatactatgcataaagggttaatatacttgttttatggcatcaatatgatttaatttttttttttttcgagatggagtcttgctctgtcacctaggctgaagtgcagtggcacgatcttgtctcactgcaacctatgcctcccaggttcaagcaattctcctgcctcagcatcccgaatagctgggattacaggagcccaccaagacacctggctactttgtgtatttttagtagagacggggtttcaccatgttggccaggctgttctcatactcctgacctcgtgatctgcccgcctaggcctctcaaagtgctgggattacaggcgttagccaccacgcctagcccgatttaatttttttaaaactcaggttctcaataggtaaatgtgcaaaagccccataaatagacagttaataagcaaggaaatataactagcaaactcgtacagaaaaagtattcagcctcactaataaggaaattcaaactaaaagcacaattaatttacttattttaaatagacattaaaaataatactcaaagttgacaagggtacaatgaaagaagagagtgttcccacacattgctaatggcagtgtaaatcattacaatcccctaaatccacaaaaatgttcaaagcttttggctcattaattcaacttcttggaatttactgtaaggaaataataataaaaaaattgaagatgttcatggtatctttatatggcttcagttataatacttgtaaatggtgagggaggagtgtaaatagccaacaattggggaatgcatatgtaaattactgtgccttcactctacccagccactaaaaatgattgttacagatattgtgtagaagcatgcaaaaaatcatctagcgcgaaggaagcaacatgaagaaatttgtgtgcatattatgactgaagggaaatggaccagaatgacagtagtcactcttacaggctggtaggattatgggggagattaggtgattatgtacttttttttattattattatactttaagttgtagggtacatgtgcacaacgtgcaggtttgttgcatatgtatacatgtgccatgttggtgtgctgcacccattaacccgtcatttacattaggtatatctcctaatgctatccctcccccctccccccaccccacaacaggccccagtgtgtgatgttccccttcctgtgtccaagtgtactcattgttcaattcccacctatgagtgagaacatgcggtgtttggttttctgtccttgtgatagtttgctgagaatgatggtttccagcttcatccatgtccctacaaaggacatgaactcatccttttttatggctgcatagtattccatggtatatatgtgccacattttcttaatccagtgtatcattgttggacatttgggttggttccaagtctttgctattgtgaatagtgccgccatgaacatacgtgtgcatgtgtctttatagcagcatgatttataatcctttgggtacatacccagtaatgggatggctgggtcaaatggtatttctagtgctagatccttgaggaatcaccacactgtcttccacaatggttgaactagtttacagtcccaccaacagtgtaaaagcgttcctatttctccacatcctctccagcacctgttgtttgtacttttatagcttttattttctcacacccacagcagttcacttcttaagtgctttcttagaaaaacaaagaaagttaagaggagaatcagtcagaatttcacctttcttttaagagcttcctaaatacagtgttttctgaatcagtcaatctgcattaatgtaataagtccttattaaggaaaaattattgtaataattccaaagagtactatcctcctttgccagctattcctcaggcactgtgtggcctcatttcctctatctgttgtgctatgaaggcctggtatccttaggcaatgttctatgtaccctttaatttatttttctgaggtggagtgagactatttggaggaagttccaaactataagcatctgctgtgagtaggaccagactgtattttctgagggtaaaccaggaaacaggttcccattttgagggggcagtgtatgtgattaagaatgagaaacggaaagaaaataaaaggatagtggaggaaaggttatccccagtgcatagatatatactcaggtccatggattcaaaacaatattttagttcagctatgctacagtagattggagtatgtgtgagaaggctagggatagggagaggaggacaaaggaagaaagggaagaggagaaggaatgataactaatgtaaacatggtctttatactcatcattttattttttgcaaatcaatctaaacttcccttcacatttcataaacaattgtagaattttagagttggaagagttctttgagataatccaatctccttagtttacatttagaaaaagaatgccctgagaaaggggaggtgattttcctaagatcattctgccacatgttctgaagagcagtgtagacgagtggttaagagtcgggccattggagacagactgtaggaattgaaatctcagtcctgccgtttactacatgtgtgatcttggcaagaaacttaacttctctgttccttggttttctttatctgcaaaatgggcatttaaaacagtacctacctcacagggtgctacaagaattaaatgagttaatgtaggaaaagcactaatatagcacctggtacctgataactgctttatgagttagctgctacagctgctgctgctgttacttttattgtgataattctgtcagttgaaggtcaatgatttccacatactaagttgtctctccctaaccttacagtgactaaataaatgaacataagtctccatggctgtcttctaaagtcacttagagtttgtcttgttagcaagtagagagtttaaagcacaagagcaagccacagatgttgacatttgaattcatactttgtggactatctgaaggcatcttctgcagtaaaaactataattgacttctttgttttgcactctgttccatagcagcatgtgttttccatacacatttgctttgtcttagagtttatcattatcaaaataatatagaaatgatattatttggatgtgaatagcattttatatatatttgatttttctgtaagttgacagtttcatcatcatgtctaaataacatttacttgacagtggacccccaggatgccatgatgggcactgactgaaaaagtcaattaagcacatgggaacctatcctttaccatagagtatttggaacaacattctttcagaattattatgctttcaaccattggtggatttaaaatattaatctttttcttaatgttttctgcttttttattttgaaaaaaatgagctatttattagtgaattcaaactctgtttctcaagcctttgacaaatatcacagttatgatttcacaactctaggcacacataattgtgtgcacctccatatcacatgctttgagagacctggaaagttttccttgtcacctgggtccactgacacaaattttaggacaaaaagttatcgttgagtgtcgaggagcaggaaaggattattttctcttagtttatactacttttgtggtttgaaggaagagtgcttccaagggcactcaataaccttgaatagatatgacattcctagctgattcatggctatgaatagttatgattggaaatttgaaagggtttccagatggctataggaaagtctctctctctttctctctctctcgttacaaataaacctatggagggaaaagagaatgcctaggtttccatgcataaaattaagggtgattttaacatgataaatcatatttgccaaaacacaacattcagcattcaaagtgagacatttttcttttttaaatttaaatcgttaggtttgagtggcattaagattagtagagattcataatcaactgaagtttaagttgaaatgaagttaagttaataaagcttaagttgaaatgaattcgttgaaatgaagttaggtgaattatttttaccttttaattttatttttgtattttaattaatagatttaattttttggtgttgttttactttaacagaaaaactaagcacgtttttcaaagtttctgtatatatgttttatcccactcagcaaccatttttatttacctaaactctactttgagtatttaatattcttgagcagcttagaaatttgagactatctttgtatatttttaataatgcaactacccttgtcaaatttattttcccttgttgtttccagtatctagtccactaatacatttcttttatagttcagctctcacagccactgaagaactttacattggtcattgtgatgatgaccctagtggcagtgtggaggatgggttggagcaggaagggtatgggggaaggaacatctacagttcaggcagaactgatgagggactgagctaaagcagtggcaactgggatggaaaggaagagagagactggagattgcaatgcgacctagcaattagctagatgcttgtgtggatggaggagtggtaagttctaggtttctgacttgaactactaatgtggccattaacagagatggggaagtttgagaacatgaacacattttgggagggaggaaatactgacttgccatacctaagggaccttcgagtaaagctgcccactttacagttgaaataggtgcacatagcttaagaaagctctcggggctagattaaagctgtatgaatcatcggcgttccatgaaaagaaaagacgtggctggatatgggatggaccggggaagctgtggcatttgtagaaaggaaagacctgtttagacgttaggtgaattttatagatgcttccttttctgggtgaaagtctaatccttggctgtaaaactacatctctggaagcctgctattggtacagttctcaatttgcactgtttgtagcaaagtaagacaactgtccacctttcttcttaggtttccatagcatctcctgaagatcatgttatggaaacctaagaagaaagagattaaaactggtgttatagatgctcaatggaatttcaatggttgtggtgacaactagttgaatcaagtgcaatccttttccaatatcttcatctttagtgctcaaacattactgtttttgtcttttgtgtatacaagccacttcattctgctttgtagtagagttgtttacttattgtgtatattaagctatgagttcctcaggggccgagactatgtcttatgcatttccacgttctctccagcccctcttgagagttttcaacagttgtttatttattcattcaacatgtattgaccaagtctctactatatgcaaggtactatgctttttctgaatcatatagcaatgaatagaagagataaaaatgcctcccttcatggagcttatgttttagtgggcagagacagatggcagatgataagcaaataaataaaaaatatatagtgtgtaatttggtaataagttctttgaaagacaagaagaaagacgagacgtaccattttttggtttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagatggggtttcaccgtgttagccaggatggtctcgatctcctgacctcgtgatccgcccgcctcggcctcccaaagtgctgggattacaggcgtgagtttttggtatttttttatgggaggttgcaaaggctgtgaggcacaaatatgcctggtgttttcacaaacagcaagagggttagtgcagctagggtacatgagcaaaggtagagtagggtacatgcttctgagcaaaggagagacgtgatatgacttagttttattctggctgcggtgtggagggcagtaatgtaagaaggaaaccaattaggaaacaattgcaataatccaggagggatatgatggcttgaactgatgtggtagtgggaaattgaagagatctggttggattctggatacctttcaaaggcaagaccaacaggatttactgatggattgcatgtgggatgtgaaaaacaggagtcaaaaatgacttcaagttctttggcctgagcaaacagaagagccttgtggccatctattaatatcaatataaagaatattatggaaggattaggtttggaaaggggtgggaattaagagctcacttttgaacatactgtgtttgacgtatcttttagatacccaagtacagatattgagtaggcagttggatattcaaagttgtggctcagggtcaagacccatgctgaagctataaactgagaagttatgggtgtgtagacagtatatgaagccaatatactggcgtgagattagattgttgttgaatcattggtgtgtgtatatatatatatatgtatatgttcatatctgctgctttctctttaagcatgctcatctctcatattagttcaaaccaaactaggtgtctccatacacagtttgtaggttcaggagttaaatagtttctactacgtgtgtgcctaaagtaatacttagcggtgtgggggatataaagagacattaagactcacatcctgccttcaagaccttcacatttgattaggaaaagaagaccttgacttgtgaaactgttcataccacaaaagaagaaccatttaaaacatatatcagtcaaatgtgtaagccttttttaaaaaatcagcctacataggccgggcgtggtgcctcacgcctgtaatcccagcactttgggaggccgaggcgggtggatcacgaggtgaggagatcgagaccatcctggctaacttggtgaaatcccgtctctactaaaaatacaaaaaaaattagccgggcatggtggcgggtgcctgtagtcctagctactcgggaggctgaggcagaagaatggcgtgaacccgggagacggagcttgcagtgagccgagatcgcaccactgaactccagcctgggcgactgagcaagactccgtctctaaatcaatcaatcaatcaatcaatcaaattgatcaataaaaatcagcctacatcatactttgaaaagctaaaagccttttttgaatgatttctgtgttctatgtgcttggcataaatgcaataagaattccaaaatatgagatagtgtacatgatagaggagccaccatttggatgtctatagatttctttgaaaatacatatggtgaagagctgaagaaaaataaaagagtcagtttcactgcaaaataaaatcataaagttaattggtttctaactacatttttaaacattgtatgaaaagaccaagttgcaaagttgcaacagtggactgaaatggtgatgacaaaataatgtaaagaatgaaaataagaacatttttacagggcttttaaatttacagaggactttgacatctcagatgacacttgatcgtctcgaaactctccgtgctaagtagagcagttaatgcctctactggccctaagaccttcagtggctcctagctcagcattctatggggaaagggggttctttcggtgatttatcatgaagtttaaaattgctatttccaaaactgatttagatcctgctgttgctgtaccagtatactcaccagaagtgtttacatcctctcagtactatgaagaacaaaaatttaccaccacctaactcattaagaatgctctgcaggcctgaggctcaaaagccacaatatgagcacaaagagttcagtccccctcaaggatactttattccatgagctctctcactcagaatccttcccttactcagagcccctgtcttaaatgtaatattaaaccagaagcaagaatgtgttctttctgaatgtagttctcttaccagttttcatttcaaatgtggaatgtgcagggttaatctttgtactcctcaccactttcaaatctgataacgttttttaatctaaccactgattttaacattaaaaacacgcacacaccatagaacaacgttgtcctctatttgaattccaatacaaatatttttgaaggctgtctctcttttaccttgagtattttctgatgctgcaacctccagcttaatccttaatgcttgacaatgtatgcatgtaacacagagtgttattattgcctccggctagcttcatgtcatctagtttgtcttttacttctctcctttgatggtattatcaggaccaattgtgaatctgccagatgcatttcctcacaaaaagataaatctaagaaggcttgtgtttttccctttctcttccaggactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaaggtatgtttttattggatctttataacaaatattatttctcattagagaatgcttgtgtgcataaactttgtttcaaaaataaatttgctaatgttaactggttaataattcgcactgcttatatatgctcagagaatctattgcatatgtcagcccagctgaggttgtaggttacatgtgctttttatggattatgcatgaatttggatgctgcagtcctcttatcagagcattcaaaatttgtgtaatcctacaaatagccatttatagactgaaggataaataatttatagtaagatgaaaagtaaacagctaagtgcttttcaagccattgcttatatgggacagaagtctcaaataaatatttggctgctgacaaagctagcaggttagtggagaccaccaaacagggttccagaaagtctatcaccgtaatgtagaaacattgtgtagccgagtctgaaaggaaagtaagaattttttagaacccttcctacaatagccatattttggagcatattctttgggcagtcttagtttctcaattatggattgacaagacagtttctaacaaaaaactagtagaaatacgatttcctgttccaattgatagataaactgtgttagacactattttaatgacgtagaagatactgacattggcacaaggttttttgtttttttgttttgttttgttttgttttgttttgtcttgttttgagacagaatctcactctgttgcccagtctggagtgcagtggcgcaatctcggcttactgcaacctccacctcccaggttcaagcgattgtcctgcctcagccacctgagtagctgggattacaggtgcgcctcaccacactcagctacgttttgtatttttagtggagatggggtttcaccatgttggtcaggctggtctcaaactcctgacctcgtgatccacccgcctcagcctccgaaaatgctgggattataggcatgagccaccgcgcccggatggcacaagttatcttttttatgaataagttaatgctgagataaaaagtaatagacttaattttctatgtcctccaagtgtggacttgactagcaacaacagcaaaacctgagaatttttttagagtgtaaattctccagccccactctagacatattgagtcagaaaccctgggggtgggacccatttgtggtttaacaaatccccaggggattctgattcctgctcaagattgaagattactgcttgaaccccgaaatatttttactcagatggcttcaatgatcacatctatttgagtgaccttcaaatatttatcttcagacctaacctccttcctaaactctagtcctaaattttcagttaacctccccggcatttccaaatgaataatacactgacacctctaaaccagtctatttaaagtggaagcaatcatcttaacactcctaatcccactcatcttccttgtatcacctacatctgttaatgatgctcccattctcccaaccacacatacttactatatctaatcagtttcctcatccagcagagttaatctctacatctctcaaatccattttctcctttccattttcatgatcattactctcattatatctcacctagactgttttttgtttctttactggtctaccgggatctcacctcatctcttttcaatccctttgctgtgctgttacatctttcttgggatacaatttgctgctatctctctttatgcatattcaaccatctttcaaggcctagcttacaagcatcctttcccactgaatccttgcctcaccatcacccccaacatcatcactgtttcactgtgtaggtgatcttcctctgtgaactttgaaaatacattctttttacttttttttttctgacagagtcttactctgttgcccaggctggaatgcagtggcatgatcttggctcactgcaacctctgcctcgtaggctcaagtgattctcgtgccttagcctcccgagtagctgggatttcaggtacgcgcctccatgcctggctaatgtttttgtatttttagtagagatggggtttcaccatattggccaggctggtctcgaactcctggcctcatgtgatctgcccgcctcggcctcccaaagtgctgggattgcaggcataagccaccatgcccggcctctttttaacctcttcttatggttatatatattctcctagactgtatactcaataaagatggggatcatgacagatctctattttccataaaattttgcatataatatatgctttataattgtttcatttaaggaattagttgctatcaactgaaatataagtgcttatcatgcattgaaaactattctttaaatattgccatgtcaaatgcaattattacaaatgaaaattacagtactctaattagtactggaatcttacattttaaaaacaaccttaaattgagccaaaatttaagatattcattctaacaaatatacattaaatatttgtgatgttaactatattactcattttcatcccttaacgtaattggtaaaagttttatatctttcttttcaaggaattcattttaatatttcccatttttttcagttaatatcatgtaagttcgttctaaaataattctcttcttctgcctgacaattgggaaattatttcctatggaaatgtttttggctttaggaaatgcctagttctcattaaaatacttatctgtaagtttgtctttacagaagatgaatttacaattgtgatttatgggttgtgggtttagggtgtagagtggttgacctaatatattgtgagtagaaataagaatgcattctggtgacagttctaaaaacataagcaattttatgctgagtcagtataaagagctggccagcctcagattttgtctgtgcagtttcatcaaaaggaatttggggtgagggaagtttgtctctatgatgtcattctaacgtcctttcaacggattctttttattcaataagcttttatttacaaattaatatgtgtcagaccttgaagccaatgctgaggatggagatgactgcttgcaggaaacttatagtgcagtggagaaaatagacactcaaaacacattattgcaattaaatgtatgaagtggttttacagataaaaaaggtgctgtggaagtacacagaatgaaacaattaacttctttagaggaatcagagtacatagaaaggtgatatttgatctaagttaaaatttgaataaaagtttaccagaaggacattcctagagagcagataagcaagtgcaaagtatacagctctgaagaaggcctgtaatggtgaaacattcaatatggctagagcaaggaatgttggagccagattgtgaagtcgcgcatgcccaatttaggagttttttaaaattccctttaagcatcagaaaagaaagctttcaattagtggagaatttcatgatcaattgtaatttttaggataagaagtgtatacaggggaattgtagaagtgtaggcagcagtgtagaagattgattgcaactggaaataatgggatgcagggagaaaaatctgtgaggccactgaattaggctagagctaagaatcgcattagaggtccaaacaatgtctgtggagatgaagagacacactcaagagatataagtgtgttcgaattgatagaacctcataattgattactggttgaggttgaaggaaataacagagtcaaggatgactttaaagttttaagtttgggaaactgagagaatagtgattaatttaccaagagaaggaacacagcaggaggagcaggtttggaagggaaaatgagtttctttttagacatgttaagtttaagatgctggtatgacatccaggtagcttttcccatcagcgattggaaaagtgtgtctaggattcagaacagatctgggctgttgttataagtagatttgagctcatcagtgtctcagaatagagatgccaggggatggatgagattacccagggagagtgtatagaaggttgagactagaaaaaggccaaggacaaaaacctgaatctatcatccatgaactgacataaacacattttgaaccaatttatatttttagccagcaccatccttcagtgcactgacttatataaaataaagtatacagacccgggaactaaaagtctggaaacagtatctcatctgccactgactgccaatcagtagagacacctaggagggaaaatatgtacccctttgaaggagaaatgacttatcttatgttaggcgaaatagtgggcctaattatcatctttttttgtaagatctggaatcctctttattgtcttagtccatgtattaccacctgtgagtcagaaaaaaatgtttttaatttttgcaaatgtatgtcagtagttgaatcttgcatcaaccaaggtaaagttgagcctaactcattattttaaaggaagaagatctcaaaaaataattgagttttagatcaggaaggatgaatgcaaacaaaatgttgattgggcacctgctatggtaccaggtacggtactagatgccttttaagtttactagttatgtaaacttaagcaagatacttcagctctgaatctgctttttcttctgcaaaattgacttcatcatcatcaccatcatcacaataataatgataaatttggaattgtacctattctattctagcactctgcaaggtgctttacatttgctcctcataaacacctgatgaggtatgcgctattatccccagtttacagatgagataactgaggcttggagagacataacttgccagaggttgcacagctaaaggagaggtgagagttaggatcagaaatcaagtcgatggctctaaagcccccattcttcactataccacactgtcttccatacctatgtcaggaggttgtgataagtattgaatgccatcatgagagtgatgatcttcaggaattcaaaaaatgttagtttcccttcattttcttcaacaaccttgccagcctccagtgaccaagcgtttataaggaggttaaacgccttttcattctgattatcattagaaaagggcagatgatatgctctataatttaccatgaaatattcctgagtctgcttatttccactttttagggaagttaatgttttatccaattgaagacttgttttgagaagtattaataagagaaaatactctataccagctgaagatatgttcatattatctttattttccaaaacagcagtgccctactccatgtatatgtggaatgctggactctaaaactgaatttcttattttccaaaagcttttgaattaagggatggacactaatataatattattcacaattctttgctaacaggatgaatgagccctaggcaggcttatttcatatgacttttggcaggttgaatagcaggggaagatttcctagaggcacacaggctagctatttttcccaagcagcctcacatccaagggaggcatcaattaactaagaaattagtattaaaaatgaaaatataaatgcatggagatatatataccaagggtaataattttagttgtgtgaattggccaataattttatatagataagattagtttttgaatatctccattttactgcaaagtaattatgaatgagaagtcatccatgcataaaaaggaggtatgttgaggacctgatacaagtctcacaaggtcatagactcctaaggtattacagatgacacaaacatttcatttctgtcatctaaatctgttcttttaacgcttctttttctccgaatagcatttttgtttggttggttggttgtttttctcttcaggattacaacctaaacctatatctcacattattgccatctggtggaaaaaaatttaaactgccattttttttttttttttttttttgagttggagttttgtcgcccaggctggagtgcattggcatgatcttggctcactgcaaactccgccttccaggttcaagcgattctcctgcttcagtctcctgagtagctgagattacaggcgtgtgccaccacaccttgctaatttttgtatttttaatagggacgaagtttcgccatgttggctagactggtctcaaactcctgacctcaagtgatctgcccgactcaggctcccaaattgctgggattacaggtgtgagccaccatgcccagcccaaactgccaatttttttttttttgccaagattacatggaagcaaagtttatctgtcatccattcatccatccatccaaccatccatccatccatccatccatctatccatccgtccatttgttcatttatacacttatgcatcagcatttatttaatgtaaactatgtaccaggtactgttctaggtaaatgaagttaatcttgaaataaatgtaccctagtgactatgattttctctctttttgccccagtatgataagccacttcatcccacagggaaaaatgcttaagcagcactgccacctgtgcagtctttgccctcaaaatttgagaagtgcatttctctattcttatatcaggcatttagcagtagtttaaatgattgtttgcttatatgtagacagtttagatatcagttccttcaaaatccttgaaagaactcttaatctcaggatctgtatttacatggcaaagatcacagatggcaggtgtaatattaatgtggcaaaacctatgaaatgaaaatttcagcagaatttgatcacatttaatgaattgtctgctgtgagcatactatgcttctagatgtcacaagtttctagcacaaaatccataatgactgctctgaaagaacttagactgtaagagaaattagccaagttatttaacaataactctaattggctcatgtctttcaactagtaacatttgttcatgaaaattcattcaataagtatttacttacacagcatctaaaactggaatggaatgtccatgacacttgtgccactgctccctctatttgtcccatggaagacatccctaattaatcatgatgctctttcccctgttgagaccagcttcagcctcacatccctttcaaaatggcatttcacgcaagcattgtcaatcaattagagttgaaaaaggacaaaacctatttctaaactttggtttgcttatctgtacaaagttctttgttaaactatgaagtttataggtgagtaagaagcaatctttgccctcaataaattcatagtacagttgggaaggtacatgtcaatcagcaatagtgatgcaatatgattgatgtgataatagtggtatatgtaaagtaccatgggggtctagaagctagaaccatgccgtgtattctgcctagggcatggtgacattgattatgagagaaatatctagcatttatgcaacaacagaccggaagtaaggcactttaaatggattctgttatttaatcttcccagcaatgctataaggttgggatcattattatacccattttacaatgaataaaataagcacagagatgctaagtaacttgcccaatattacagaggtagtaagtgatagaactagcatcggaacccaggcagtctgaaattagagcccactgtcataactactatggacagatagactgctgtaaatttagatcaattttaaagaaatggtgtctgtgtgtgtgtgtgtgtgtgtgtgtgtgtgcgtgcgcgtgtgttgtatctgtttatgcatgtgtttggagacatgtaatattgctaaaatgtccatattacccaaagtgatcaatagattcaatgtaatccctatcaaaatcccaatgtaatttttcttagaaatagaaataggtggttctattctatgaaactacgggagtaaaagagatgaccagtgaaaatacatacaatcagaaataatgagagccaattatcttaccctcagaagcactgaatttaaaatagtgggcagaagcaatgaagtggtcttgatatgtcatagaagaacaaaaaggaatgagtatcacataagccaaaggaggagacttttcagcaggaagatgtaactaatattgtcaaataatagacagtaacacagccagtttagaaggtcattgctgactttagactagagattgtccactttgactggacattaaaatcatctggagagttttacaaacctcaattccaagactgttccccagaccaattaaatcagaatttccagtgggcgggactcaggcatttaaaaaaaatatccttgggggatgccaatgtgcatccaagatagggatccactgccttaaaataagcagtttcaataatattcaataatattagagaaagatgccaactcacaaggatttgaagggtgagtgcaagtgaatgtagatgagtttattgccataaggctcaactggagaatgtttctggatctcagttggaaggaaaggctttgaaaggggaatgttcactgcatcctctaagacaggaagtaaattacaaaatatagtggtgagaagttaaagtagtttatgacttgatggtctcacccaagaaaaatgagagacagggttatgtgctgaaagtgtgaatcaagtcaaaggcttcagatgagtagtgaggtaagtttttgacgaggccaaaacagaattgcacatgcctatctagagctcaggtgaggtggaactgtagatggagatgtgggaacattaatgacaataaatattgttgaccactatgtgccaagtactctgctaactgagcttgcatatattttttatttagtccttatttgcaaccctgtgatgtaaagataattatcatggtggtgggaggcaaccaagcagtaaactctgcccctacatttcaccctcccttgccattatgtcatcttgatttactactgtcaccatcaactaggaagttttccacttagtgccaaaaccacagatggtctgggttttgtttctaacaagagaggtaatatttccttatataaacatttatacaacacatcccttcatataaatgattttacaaattttgctgatgagtatgaatgtatatattgtacaggtaagtctggaacccagtattggagaagggaaagaagccagaaaagtggataaatggaggagggaggtttatagtggtgcagtgtagatgttgcaccttcaggcatctttttgaaggtcatcatttctgtaaaactccctctttccccttcatcagttagctaggagtataggtaaccacagtcagtgacagtccatcacttcctagataccaatttattaccaaatggtaggagtcacctagtagggctaaatttgatttaaataatttgctatatatattcttaaattaactttatgaaacaatatacaattacagctaactacatacgtattacacaaatgtaattttacctttgaccatcacgtctctttgtggacattctttagctaggaaaagctaggtcagtttcaaaattctttggtcttgctgcttctgaggctacatgactttttgatctcagtctgaaaatagctcttgcctctgcgcattcattctatttctgtggtctatctctgagcccactttgctcaattctatgttcaaccctttgctgcttcttcctaaatctagattaaaaactgtaccatagtatgagaattgattctagtgttttcttcttaaataactcttcaccaaatggaattgtgtatttcttttgaggatctacataatatcagaaggaaaagactgactccctggctaagtgtcacatagatgattgtcccctgggaaacaaagcaactggtttttggggtacataattttgttcctccttttaaattacttcagctactgggcaggatcaaaggggatacatattcatgggactgtgaagactgggaaaaagagctttgtctttttttcttttaatactttaggacccatttattatataattaacacaaagaggcagagacacgggtcagtaagataatctgaatagatatcatggctaacacaatagataacatggctgaagtagcgggactgttcaagaatgatgtaaaaggaaagttagtgaaatatagaaggaatcagttgctaaacctaaagagtgaagtgaaaagacatggatttgattcagtagatgacagggaacctcggagggtttcagttcataggatttattggaactatatccaaattacatgctgcttctcttttattacaaggatttgaggaagattcagaaatggcattttgaaatgtagcaatatttcatattaacagtcaaaagcagttttaaatatctgcaaaggcataaccatgaggtatgccaacatgtcctgtcaggaaatcatcctgtcagcaaactgttattctgctttttttggtcatctgtgatgcagaactggctccatatacaaataagttctgtttattttcaacacttttttctcattataattctgaaagggtctagaggtgacggaagataaactttgaatcccttgagaccttgacaatattctcatttgaagcatttataccaaaagatgagaattcttctgtcccaccagtataaactgagccatatgcagtgctattttggtgccagtcattcttgtgacacatgaagtatttagttttgttacaccagagtcaaactgttagaggaaatgaccctttgtgtcttttatgtcatggaagaaagcagttagaaataagctcaaaggcaaaaataattaataaggacacacccaaacctttcatgaaatttaaaggtttgagttaagatttatttctcaagcttcaactgagatatttataaggcttcactactaaagtccaattatgtcttctcattaatggttgaagtccaaagtttcaagaacacttaaaaaattatcacattgacatacaaccaggctgaatgctaatgtgtctcaaattattcaataaatatggtcaaaaattaccttcactgacttgaaaaaagtaatctgtggttttgataaatgagatggtcacaagaaatgcagaattttattgtatgttttatatgaatacatatacatactaatgtcatatatttagtaatcagatgcacatacacacacacacacacacacacacacacacacaccccatacataaggaacagtgaagtgaatcaatttgtaatggggttgttctctaatttttttctattgattgcattttcttaagcaagatgtactagtatatgataatggaaaggcaaaacagaagagatgttatatggagcagcaactaacattcaaacatggatgcttatgctcctttttctcctgcagcttcccatcccacatactctaagccccaggtatgcttgtcaagtgctagtggttggcaagctttatgtttcttattggtttccttcagactacctctaggatagaggacaatcaacctgatttctgaagcattctaaccataacacacagccaggatatttagtcagtgtgttctttcgaatctgcaatatgattggcagtaccaaagcatctggccaatggaccagggaacatacctgatcaatttaacttaaaagtacaagctacaagcgggctggctgtaccatcattctgccaccatgattttataatttactttagagcttggaacagtatttggcacataatatgtattcagtgaatatttattgaacaaattaatttattaaatgtataacagcactttcttttggtaaattaagttggaaagagactcaaattagaattttccctatttgtcacattgattgttatatatatatatatatatatatatatatatatattttaacttttcatagaaaagtatgtggtagttttagtaaatgatgttttgtcataacataaaaatcaagtttagataaaataattacacaactgaagtccaagttcataaccctttgcagttaacaagagttagtctaaaatttattggctaaaggctttctaaaatacatgtgtcttctttataccactccttggtttgtagaattgcatttggatgtggaattggtttagaacattgtttgtatacacagaaggatgttattctggtcagctgcttccactttcattgcactagactatagatatagaagccattgaagaatggcctcaatgtagaaatgaagagaacctaaaagcttggaggtggctttgtatttttgatatttgtctcatttttatcaatgccaactactggggtgaatggaaatgtagatattccaattaaacaaggctactttttattctgtggttttttttattaattgtggctgcactgtactaataagatgattcaaaatgtatatttgaaacttttatttgcatgtatttatgtactgtgggattaaaatgtacatttcaatataaagtctgaagcctatgttgttagaattgtgacttcataagaatactgtgaagtctgtcacagtagaatttataatcttacatgacatccgaattcaacaagagtgtcttgagaaagttgcctttttaacaaactaaacagacttttcacagtcattcttttggtaaaacacgtgcacttttactaaaataaagctttaaaacatgggaactataaaaggaaaacaattatgcagtttttattactcaggttcggaaccaaagttcatagcacttaaaactgaatcacaaggctgtcaaggaccttgagagaacatacctttcaggcaggaccacactaagcctacccagctaaaaattacataaaatttgattctatttcagccctatcaccaagcttttgtgatagtgtgttgattttttactgcctacattattataattctacataaactttcattctacttatacttaagtctcaccagagttcaactcagcaatcactatttccaaaagaagtattcaatacctatttgttgatcactgattttgaaggcatcaggaaatttctaccattttctagtgtttgacagtatttagtactaagcacattttactaaaattccactggtcctttcctcttagagagcatggagtataaccaacaaccattaaccagtaagtagatactttgatacagtgcaatattttgcacgtaataggtcaagtatttaacaaacatttagtaaattgaattaaaaagttgattgtttttgttttgatgtatttgttgcttaattattcatgatggtataatagaaagaatactgaactaatagcaatttgggttcaaattgctcttttacttaatagcctagcacagtatcatcacagaataagtgcttaggaaatatttcctgaatgaattaatgaattgagttgaataaatgaagccttgggccccctttcccctgcaaccctctcatatggctcctctcacttttcaatgtgcctcaaggatggctttcccctgaggccactgtttctccatcaagggtgcctttggagcctactcttcattatcctatgctctacaaaccaaattctttactacagcactaagactcctctaccctatgttaaaaaccaacaagcctcaataaaatactaaacctacttcatggtacatgccattcagctatacccctaccaatcttaaaggcatggcacctcatttcttttatgtttttggatctgataaaattattcctattgatccaaatttggctatactcctgggtacatttgcaccagctctcatctctgactgaaacactgttccaaacccattcttcccctctaggggaaggaacaataaagtggatcaatttgtaatgggattgtcctctaattttttacttggctaggtacttctcagcctgtgagtctccattagagtctctacctagaaactacttgctctggaaagcctgccttggtgccgtgcaatcttgggtggatgctcctgctgtatactcctacagcagtctgtacttattactactgtagcactaatcaccatgaattgtaattggcttgtttgtttctccacctagactgtaaacttattgaggtcaggaactatgccttatttacttttataaaccctgtcatatagtaagtgctcaacagtttttttcttataatgagataacttttacaacgttttgtttccacttatgtaaagtgaggatgtttcctcgctgtggtgcagaggatcaatggaaattgtatacataaatcattctgaaaagtgccaggacacaagaattattcctgattgtcaaatcctttcacagatgcttttaacacacagattgccagtttcagccattttcagagagagattttctcttcatacttaggatctagtaagttgtgtcactgtaaataacagaatgaattggaactttatacataggaataagggagaatcctatctccacaccagccagtcggactttgttgaggatcttaagttcccatgcccttgctctgtaacttcatggtatagaaatagagcaatagtggaaacaggtttaacaaaattcttagtcctatcatggtaactacagttgtaatacctccaattaagctgctatgaaacactggagaattgttttcagttcaaatcttctagagaatgtctctgataaaaatgacgcctgtaatcccagcattttaggaggccaaggtgagtggatcacctgaggtcaggagttcgagaccaacctggccaatatggtgaaacaccatctctattaaaaatacaaaaaattagctgggcatggtggcagacacctgtaatcccagctactcaggaggctgaggctggagaatcgcttgaagccaggaggcggaggttgcagtgagccaagatcgtgccactgcacttcagcctgggcaacaagagtgaaactctgtctcaaaaacaacaacaacaacaacaacaaaaatacacaattaacatcagataatacaatttttaaaccctgaaagagtattgattaaaataaaattcctaacatttatcttttttatgcacattaatcagttggtttagaagagtcttgcttgactacaacttgttaaagcatcatggcttttgtacactgtagattatgtaaactttatgcaaaatagctcagcagtagatcttgtgctccctctaatacatcctgatggcattgaccccataaatggagttttagtgaatcttcaacagcagatgagtctttccccatagtgttcttcatcacgttctctgttgccttcatgccacaaactcatttgaaaggttttatgatccaattactaccaacaactattacttcagttactatcattacatagccatatttattaaaaattctgtacatactagtggatcattttattgtgaagttcaggaactgttaaaattttgaacaaattagtccaaacagtgtcctttattgctagattatgggaggcagattctattgatgttgtagtttgaataaatggaaatattgctctttatgatacagatggccttcctaactaagcatttactggattattttacaactaagtctactcagagtgagaatgaaagagtttctaatcttccaagggattttttttcttccttgaaaggttaggataactagaattggtagctcataaaaagtataaatcaatattgccattgacttaatccacataagaggcttaacttcataggtgacttctgaacagctgaaacaaaacaaaaatcagtctctggtgagttcccaagtttaaaatgaagttgaaagctgttacagaaaaatgcttctagaataacaacgacagcaggatgggaccttgtaaaccattatacttcagcaagtaaatcctcgtgcttacccattttaaagaacaataatagctcatctttaattatgtgtcagacactgtgttaagcatgatctcatttaacctttaaaataaccctgtaatatttagccacatttctaatccccattttacaatttatgaaattgaggcatggagaaggaggttatagtaaacagcccagttgaaacttgaacatatgtctactggacactaagtatcatgcccttaatcaatatactgtaatgtatatgtagaaaggcattcataaaatatagtcattggtgttcaaatgggtctataatgagagctgatgctctttacatacaattagaaatatctgcatggttttcctagttaatagggaatggtataccctgagccctctgcacttaatgtcagggatccactatgattagcattaggccaatataatttgcaagattgctgtgcaagaccgaagtgtatgccatggccaagggacagtgttctttcctttgccagatgagctgtctagggtgaagatcaaattattgacctctctctttctaacactatgaactaactagctgaattaactgagccaaaaataatttactcaatgataaccaatttactccaaggtgttcactggattatttgacaactaagtctactcagagtgacttctttttagtttttttttttttttcagttttacagcttcacttcttttaaagttcataccatctgactattgttttctccttccttctacctcattaaggtggtttgtcaatcttcagacttacagacatttttcagcgtttgatttttgcatcgtggtctttcttatttcattccctaccactatttgcaggaaacgcaacatttaggttaatgatttttcttagagtttcttgaaatacttagctcttgtcaagatcaccgaggtctccatggtgctaaattcaatggtcaattcttagttttcatcttgacctttcagcagcatttgacaccgctgatcattcactgtttcttctttacctggttttcaagatatcatattctgagcctcctcttatcctactgaccattcttctaactctcttttattggatccttctcatcctcccaactattaaacatcagacagcctgagaatccagccttcagacctcttctcttacctttgctacacttattcccttggtcagatcatcctctttcatacggttaatatcatttatatacagaaaacacttacatcaccagctttgacctctcccttgaaattcggattcatatatccagctggttattttttatttccacttgcatgtctgatacgtatctcaaacttaacatatctgtatcggacacctctgattcacctcgcattttcaccccacctttttattccagctattgctgcgcctactagctgcatgcagatatacactaacaacacgtttttttcaactgcatcagatagctctcattcctgccttttctgctacttgtatgtggaatgcctgtagcaacccactcagccattctgaggcatgtgcaagcctggaagtgtgagagggttaacacatcatgggacatcccttgatctagaagagaaagaatcattcatgactgcctccctcttttgtatttgagcagacaattctcccaagcattttacaagctcttcagagggtgccctgtaagatcaagcttcagctgctctcagctgtgaccagctcaaaaactcaccctttgacttgcctcacttctttatttcacttttactgatcctccattcttattttggggatcactttccaaaatttacttcctacacacaatcccttctttcactgtctgctttttgggaaaaccaagctgagacaatattcaaaacagaactcctgaccctcccttcaaaatctgctcctccgactttttctgtctcagattctggcaactcttatgtccacatatttatatcaaaaaccttgatatgattcgtgacctcatccattttaccatcaaaccttgtcatctctgtcttcaaaatatatccaaaatctgactaattatcatcacctcttttgctactaccctagtccaagccaccatcagttctcatattgatttttgcaataggcttttgactgatttctctccttttatgctcttacacccctacaatttactcaaaatacaatagtcagagtgatactcttaaagcccaaagcctatcacttccctgctcaaaacctggcatggctcgccatctcactgaggacacagacctacataatgtggcttccctttccatgtgtgactccatctcctgctactctctttctcaaccattctgttacaaccattctgttgtgattctgaaaaatataggcaatcactattccctctgcctgaaatgttctttcccttgatatctacctggatagggacctggctcggtctcttgcctgatgcaggttcttacccagatgtgaccttctcagagaggcattccctgactacgctattgaaaattacaaccctcctccaacacatttgttttcctgcttttttctttccatagtgcttatcatttaggtgaccatatgatttattgtctaaactgggacattttttagagtgaaagggtgtgctaggagtaattacactaagaccacacatataaaccagtactatctgagaaaactgagacattatggtcaccctatttatcaccatctgacatactattttgcttatttctctttatgctttacatatttatttatatttctatatacatatttactgtactatacgttcaaatatgtataactatacatttatacttattagtatatttttattgtattcatttgttttctgtctttcatactagattaagttctgtgagagcaaggaattttgtattttgttctttgctgagtcccagtgtttgaacactgcctaggacacactaaccaggtggtaaatatttatttaagtaaagcaaaccaacaaaatactaaaataatgtctggcacataattatctttcaatattgcttattgttatcaatacttattattagtgttgttgttgtttgtcctcaaacaaaagctattactttcagctctgagtgagaatggtatattttagatgatattgccctattttatttactcctcagtaatatttttatgagctgcctgtatagagatgtttgcatctgccaaataatttttatttaagtggcctgctcttctccagctttttaatcaggatgcttagtagttgggtggcttacaagcctttgtgattcatgacatacagatgaatttttcttttatacatcagggtagataataaaaaaaattagctggtaaaccctaaacccttgtatgagttcctattttaaaatatattggattaatttatttaatgtccagttgtgaacatgtttaaaagactcttgaacttatcattataataataagcaggatatctcttttatacttcatccagttgggaaacatagctaaaaatatcttaaaagaatgattttgagttctttcagtgaaattctagaaatgcaaattcagataattgtaatgatcaatcatttactggtatgttaatttcttaatgcattcaatttatcagcagcaggtttttcctaattctaaagaagcaatgcttaattctctttttactgattaattgtagagaattatacttctggcagttgacaaagggacttacatggcttgcttcaataccattcaagacataggtaaataataaaagtaaacaattcatgagaagtggaaacataattaacagcaatcttatgactgtttgtctcctcttgcaaaaatcctagtaagctatggcatgagcttccagttttctctggataagaagtacttgttagctaatcaatgtataatccccagtgatccttaaatattaaaaagttgacattagccaattagataattcaattggacaagcatttatggagcatttgctattcaagaaattttcttttggtcacagacaaaaatttaatacagcagcaccgctttataaaactcatgttgagaagcataactgatagcttttttattttggcttttgttttactgagcttttatttttcaagacacaggattttctctgcagtacatttgtagccttataatcgtgtgctgtgttataataggattgagctttattgagatatggttgaattgaaagttcactaggtaagttctttcattttaattctgaattccatgctgagtagctttgtcttctaaccttttgtgcagatagtgtcccttattcccatttgcccccttttggattgcctctactatgtggtctactagaaagatcatatcactgggtcaaaactcatgctttcaattttgcttctttcactcactgaatgacctcaggtcttcttttaaccgcctttactagtatattaatagtcacctggggtctggtggcacagttaatcaaagacctaaaaataatttgaaatgtacagccctcccttctgcctctagagagaatcttcgaaccaaagaagaaaagtaaaatgaaaagagagatttgctaggataatcaacaagatctctgtgtgatggtttccttttcagcactggcctgtctgatcctccttagtctcctaaaactgaaatgctcgtttctgagattcttctttataattcctcatttgaagaacagaccttagaaagtgacaagacatctatttgaaataaaaataataaaactggcgatatgtctttatctgcttgtgttgagatacgaaagaacagaaatgacttccaagttatatgctaatataatattgagcatgatatacatgaagacatggttcagaagaagtgtttgaaccctagcaatagacaaattgtaacaaaaaggcaggtaagaatttagttctcctctaaattacattaccatttctttttctccgctgttttttacctctctgcccaatgctatgaccagtattcagtgacttcctgttactgttaatagacttctactttacttggttaattgtagtcttatcaaaataattgtgaaaaattcaaaggtacattttggaactattcatagtgagccctgcggggcgggggggaaagcataatcttcaaggtgaactttagtgtgctttaagcacattcctctccagtggggaggatttcaaaacttttgtcgtttctgtaggcaatgaggtggatatattagaagcgtgaaagacaggttgaaagtgatcagttaggaaaatgttgcaataatctagagaaagagatgattaggagcttaacttaggcattaaatatccaaattttctaaaagggagacatacataggagataaatttaaattggcaagacttaggggctaactggttgtaagcaatgaaagagagaaaataataaagatttctgaaaaaaactggtttggctgtgtccccacccaaatctcatcttgaattgtagctcccataatttctacatgtcatgagagggacccagtgagagaaaattgaatcatgggggcagtttctcccgtactattctcatggcagtgaataagtctcaagagatctgttggttttataagaggaaaaccctttcacttggctctcattctcttttgcctgctgccatgtaagacatgccttttgccttccaccatgattgtgaggcctccccagccacgtggaactgtgagtccactaaacctctttttccttataaattacccagtcttgggtatgtctttatcagcagcttgaaaatgaactaatacaatttctatctttggcaagtcattaaagaggaggatggtgctagcaatcaacaaaggaaggtagggaagcaagaaggcagagttttagggggaaaaataatgattctcttttgaacgtgacttcacagggctgtagtttctccagatagaaatatctaatttgaagttagatatacaagacttggagtactggggctagaaaatggatctggatattgttgatacataactgatatttgagactggtgtgatcacactggaagagcatgtacagagtagaaaacataaaaggaagaggcaattgacaaaatcatgtagcacactaaacatttaaatgactgacaggaaaaggatcccaggaaaattgctgagaagtggactaatggaaattcaagacaagtggtattatagaagacaagaaagaacaaataatccagaaagagggaacagtatcgtatatgaaaaaaaggtctcgttaagtaaagactacaatatttaccagttttggcatttaggagtttattgctgactttgaaaaaagagatttttagtgtagtagtagagaaataagaaagatttcagtgggttgataaataaatgcaaagaaaaggaagtggagacatcaagtataggcttttaagatgcttggctgagaagtgatgggatggtcaaggagagaggggcaatagctaaaagagaacacaggttttaggaaggaatttttttgttgtctcattaatttgtttttttggatggaaaagaaacataagcatgtacattaacctagtcctgcccctcccacagtggcaatgaataaatatttgaagtatgaatgaatgaatacttatagtcaagggaaaatgaactaatgaagaaaaaatattaagtgatagaaaagagaggtagtatctgatggagcaaggtcctggagaaagcctaaataaaggatccagaatacagatggaatttttggtctctgaaacatgagaggagcagggataattgagggaatgtgtcatgtctcgtagcatctgctgtctatgttaagtaggagacaatgtcgtctgccaagattcagggagagagggctgtgagtagagtaagaaacattagcagaatgaacaatgagacagaaaaaaatctggaaagtggtagtagggttgcagggaaagttagtatataagttagaatctcggttgtaattgacagaaagtcaactcaaactagcttaagcaaaaagtggtatgaatttattggctcagggaacaaaagaaagtttagaatagcaaactgtagaaagggcaaggatatgactgacataggaaataactggagctaatgaatcaaatatgatcaatatagtatttatatttttctagtgggcattgaatttaaacttcattttctttcatgtacacaggcttagtaaacacaaagtgtgaaacatggctcatacaggctcttgaccatctcttcttaccaccctgatatagaagcagtgtatttaatgggtccaagacctagaatcctaagcaaggactttgattagccttgctttgttcagttgcccactcctgcatcaatcacttgtggccaggggtaggacctgcagaatgtactttgattgacaaagcttaggtcagatgttcacacatgaactgatgactgtggcaattgagtccatcattcaatgagaattttttgtgttctgacaatgtttcagatcttgttttaggtgttggggatagagttgtgaaaaacatagacatggtccctacttttaagagcttatactctagtaaggagagattgataataaacaatatattttggctattgatatattttattaaaaaattaaaacaggattataacaaagagtaactggcagtagggtctactttatttagccttgatggtcagggaagtctgaatagctgacacctggatcacaagaataagccaactatttgaagatttggatgaatattattcagacagagggaagaacaagggcaaaagccctgactgatacataagcttgggatatttaattagcagaaagagggccgctgtgagtggatcttagtgagtgaagagaagggtaatgtgagatgaggtgggagaagttagcaggagctagatcacataggactttgaagccactgtaaggaatggctattaggatttatccagtcaaatcaagtgccttttcttatagtaatcattcgaattgagggccacgttcctgggaaagggatattaaatacagtaattttaattttcttatcagtccaggtgcagaaacagtggaaaccaaggtaaaacttcttggaggttcgactgataagataggtcaagtagaaacatgagggagaaggcagaggtaatgctgttgaaagactagttaaaacagctgatcctggattccagaccaccatagaaaagagcagaagttaggagagggactgattgggaaaataaaagaaggttatcaatcttgtggtctttgtcaaggttgaaaagtaggttttatggccatgaggaagtccaataggtataagcataggctatcattggcggagtaagatttcctagtcaaaggtgttgtaatgtcctttcttattcagatgaatacttgtttttatatatttatttgtatccaacctaagtccataaataccttgttagtgtacccagtttccaaaaacttgctgattggggttcaaaaatactctatctccccgcctccctttttaagttgtgatcttttccattattaaacattggcttttttcccagggatggcactgaagaagaaaatcaatgacatatctagccagccagcttggactgaatgggcattcaaatagactccaagggccaagtacagatggtgatttattgtgcatacaacttctacagagtgccttcatttgagcatcgatgtatatacaattactcaccagaatgctgcagttttactatttagccaggaatctgtggagagattatgttcactaagaaatccacacatgtagtttctacccttttcagcaactctagaaactctcagtagtcttctgcatgaagaaaagagatttcaaaaatagttcttccattttaccatatttctcactattgtcatccttatgcaattcccatttcagagccaattcagatttattaaaccatgttcctctactggcatgtaagtagatggatttgctagaggcaaatcatttactgtggctattgtgaaacctaaaattgcagtagtcgtctccacatatcacaggctttcttattgtaaaaatcatttttaggcaatgtttatgtgatattgaaacaaccaagtggaagttcaactgtttaaatgaagcagatatttgacatcacacaggcagaaaaacaatgaaggcacttctaaattcctttttctcacggaaaacagtttgagtggccagtttgcccttataatttgaacttcaattgaaattgttagcaggttatttatagctttaggaggataatttccaaaaatcttgcttttcctctctggccaaatattacctaattgctatcctatttcagaaatggcatcatgtccagacatttataggtttatattgtattcgtgttttattatattaaggagactgggttgttggggtttacatcaggaattgaattatgttgctctttgcataaacatatatggagttatattacaatgtattttctttaatattttggctaaatttcagtgaaaaatgttaataattttaatagaaacacttcagaccaatcttcaacgcaagcaatatgatgtcaagattaatagaagctataaataaaaagaagctgtaataatattgataaaaatcagctcagcaaatgaaaatgaggaaattcaataacaaataatatactgcaatgacatagcccatcgagttgctatatgaggcaggatgaaaaatagccctttaaattatttatgtaccttgcagtataatcagtatcttggatagtaagctactagaaggcataaacaaacatcgtttgtatggtgctaagtttatcaccctcaaattaaatgtaaatatatgcatctgatgctgcgtagtagtgcttcttctaatgtttttctgtccatcatcattgacagacttttcagctcttattagggttttcttttcttatctgtattttctctttcctttctcagggagtatcttcttttggatcttagtatgagttttgttatggaaaagctcagggtctatgttggtacagatacagggagaagcacttagatgagcatcatctatttatttgctgagcattgcaataagcactattggagcaggaaacatacaatttatggaccctatcctctatgtatagagtctagacaggagaaataaacatatgcctttggggaagtttaaaggcacttaaatataactattcaaaaaattgaaattagctgattgttccatgttgtttgtaatcgaatccattcatttatgataacagtgtatctctatatagttatagtcattattgattttctattattatatcatttgttgaataaatgagtaaataaatgggtgaatatctttagtggtttttgccagtatttatttacggctgaaagatcgtggataagtgcttaatagttacactactttttttttttttttcttttttgaggcagagtttcactcttgttgcccaggctggagtgcaatggcgtgatcgtggttcactgcaacctccgcctccctgggtcaagcaattctccttcctcagcctcccaagtagctgggattacaagcatgtgccaccacgcccagttaattttgtatttttagtagagatgaggtttcaccatgttggtcaagctggtctcaaactcctgatctcaggtgatctgcccacgtcggcctcccaaagtgctgggattacaggtgtgaaccaccatgcccggcctagttatactactttttaagaattgtgaataggcactgaatatctgttcatcaagattgtacctctgtgattaaccaggcttgattttgcaccaaaacagtacagcattgtcattgcactcttagtatttattttgcatttgcttagtgttacatcaagaaatagagaacatctattgtgtgccagacaaagtactaagcactgagtacagtggtgaatgaaacaaatatataccccgtcttcattgagctgataaactacttagggataccaaatagtgctatgaggtgctatggtgaccaacagagtgtattcttagaagataacagggtgaggctagggatctacttagtgtgtccagggaagtaatctttaagctgagataagaaggataaggaagagcggagcatgtgaagagccagggactgagcattccaagcaaggggaaacagcatgtccaaagactataaggcacgaaagagtttggtgtgttttaatgactgtaaggaaaccaatgtgattatgttgcagaaagggagagaaaatgtactacatgatgaagttggggagtcaggtggagacaagacctaagggctttgaaaactatgccaaagattttagactttctcctaaggtaatgggactatattgattggttttaatcaggggcagcagtggggttcacatatataaaagagtactttggcagttgtttggataatggatggggaatacaaaaaggaacaagagaaatcagttatcaagttactgcagaagtccatgcaagaggtgaagctagaggcaagtggactaatttgagatatattcttgagatataacctaaaggaccttatgttcagggctgtatttgagtggacaggaagagggaagaatcaggaatcagtcagggttctggtggaggaaactaatgtccggaaaactgagaaaggaataggtttcaggttagaaatcaagaattctgttttaaatattttcatttttagatactcatgagacatctaagaatataaataggcagttgcatttaccagccaatgatgtagcaatttcagatatttctgctgtaaaaaattattgacatgagtgtttgaatgtcatgctttaattgatttggtaaacatttgttgggtctctgctatgtcgcaggtattgtgctaggcactgggaatgcaaaggcatagttgctgccaaaaaggagtttattataatcaaataaggagactgaaaaaaaagcagataatttaaaacacagtgtgataataacagtaggaggaacatctaactcaaataaggggttagaagggtcggggaaagtttcctggaagatatgacatctgagttaagttcaaaagtaaaatctagccaggcacagaggagcaaaaggctgtgttaggaaaaattgtaccaatagtggatttaagaaaaatacaaaagtgagcatcttaatatttctggccacagaatattttatgcctattacaattattattaaatatgtccataatatcagaatcatcgaaatgaaagagctgttagaaatcatctagtatagccacttagctttacagaaagggaattggactcagggagaagtgaactgtccaaatcatcaataattctactataacttttttgttttcaaatattgtaagtttactgtcaatccactgtctaaatggtgccccaaagcattaatttaatccttcaaattgcccacctgttacaagaggatattttatttccagagagattttgttgttctcaactctcctcagttattattttccacttaattcacagtgaacaatgtgaaacgatctttcaataagtgatacctatacaattaaacagctttgtgtaacatacagggagatatttaaaatataatctttcaaaagaatgttcatagtcacattctctttattcctaaaccatttatagggctccattttcttccactgggcaaaccaatggggttttgggagaaagatgaaagagttgattactcaaaattcaattatatttggttatcttatagcccttttgtttctactgctcctatcttctgccggactaacactctgatctgctgcaccactggtttcctacctgttctgccaccgttgtttctaacacgctaagaaatgcagttcctcacaagccatacaggcagtagtcaagaagaatacaaaaggagagaacataatccattttcctttcccttctgtccctgaaatgccaaatacacaatataaaggagctgaaatctttagcaaagagggcagagtatgccatgacaatagcagcagtgtctccaaaagcaaagtattgtatagtaggacctagctaatttagaccagttgagaataagctcatctgaatgtttgaatatgttagtaagaattgcattttcattattctaaaatgcatggagtcaggcactgtcatgtaatgcagtctgtttggaggacacttgtagtaatatctgacaaaaacaaaatggaaatgctttaaatctccatctgtggtgactggttaaaaaataaattcttccatctatgcagccattgagaaagatgtagacagatatatctccaatacattatattgttaaacaaaattaaccaagtatagaacagtctgcatcaaaagctcccaaatttcattgaaaatatgtaatccacatacatgtatacacaaatatgcacacatttcatttgatacacatatataaaggtatatgcacataaaaagatataatgtgtgtattacaaagtattcttctttgtaataaaaacatgagataaaatgtgaaaatgtctaggtggaaaataaattgtgcaaaatagtacaagtaatattatatagctctataaaaattatagagtagaatatgcaaaaatggtcctaaaatgcaatggaatttaaactgggtaaataaagtgtggccaaatagagatcctttgactcctgctttaatgaacagataagaatgattaccagttattggaatgtaaatgtatgcctttaaagtgctttttaaaagcttattttaagaagcttaagcttttcctctccaaattttaattttgaaattaatttgttttatgcacatttttcactaatagtaaatttctaacaaagcctgtcgaaattttaacaaattctggatttgtagaacattaacgaggactttaaacgtctttctaaaattaacaatggataatttctagtccctccttttaaagtgcactttgaaatactgcattaaaaattgtctgtaagttgagaaatgactcaagactgttctaatcactcttgataaatctttggatttatttatactctttgaactcatggacatattctatttgactggtgaatcaaatgctcacaaagttgggttgttggaacagggctttcccaattgtattttgtgtgcctttcttcctttggctgctggccttttggccttttcactgctcattaacaccttcttggcagtgtggagagctgaaaaaggtgaaatacaaactggttaatactgctaccccagcataaaaatctggaagtagggcttcatgaaaagcagaggttaattttctctactacaaccacatgaataatcaaaagttggagctatagagttggaggatttggttttaagattactcctgggattattttaaaatagaatttatgattgatttgaatatgaactcaccaagtgtagtgacttgactgtggaaccctttcagaggcaactcttgggattttttattccagtactgattgtgatcttaaacctaagtatgcagagatgcctgaaatttaattaaggtaaaaatttaaaaatttatttttccgtttgaattatgtgcaaggttagaaaaaccccatgtaaattggtggtaatttatttcacttgaatccctagggacttacatttccacattaataagaatacactgattcttacacacaagggtaaatatagtaactgagactcatgctgaaggtcatgtttggaatctcatatttcctttgcatcttagtttcatacattctttctggattctttctagcatttccaaatcctattcatcctcagggcctaactcaagtctcgcctctttgataaagtcttccttcacaacttctgacttccacatatattgctcactgccttctgtgaactccagtttttattgtctgacattcacagctttgcagttgactatttactggcttaagcactggttgtaaagattgtctccccagtgaaatgttaagttccttaaggattgcaaatacttttaattgtattggtatagaggtcttttgaattccttgcaatacctaacatagagttcctagtaggtactcaaaaatactgtactttttagtccatttatggactatgcatgaattacatttaaaattccttctatctcactattgccactgcctcaattagttgcatcccttgctagatcattttttttacaaggcaggacaaaatattgccactgatattgaactctagtttggcttatctgctggcagcaggctttcctgtagggcattgtgaacgtttacaaagctagtatagctaatctgctacagagctatcttgcccttttggtctgatttattctcattggccttaaatattctctgggctactgtggaagcccagaattcgacttttgcaagcatcaatgaccaggtagccgctttgtggaaccagaaatgatggcatgttcttaagtgagcatccacagttaaaggcgaaacaattactatggggaagtaaggccttttggcaggtgtgtgtgcgtgtacgtgtgtgtgtgtgtgtgtgtgtgtgtgcgtgcgcttggcgtcctccctccccttacaatctctgtctaccttaccagtcccagtaggcttcatgccacctcagattcaacacctttaagtcacattttaatatagcacataatagtgtatcttctttctccagcgtaggccacagaaaatgtttgcctcccttctctcttggggcctttaaggaatttctttctatcagctagaagaggaatttgagagactatgaaaattgaaagacttaggtgaaatcttatgtggttactctgcatccattcctgccgaggaaataactccagaggagtaagggaaaatatttaagggttgcaagagtcatcctacccttttcttgggcgttttctgctgtttcagcctcatggttcctctccctgaaaagaacaggtgtgcctgacagcaggtgtgtttgttctacttttcctatggcagctgtcactccccaggtaactctcttttccaggtggtgaattcttacaacccatcgtcttctttcctggctaccattactttaaaaaaaggtttggctgtcaaccctccctccttttagaatcttttgaaatgttattgttgtgattgttgatttttttttttttttgcttttgtgttttgggatgactttttaagggaaaatgcatcttcagatggattctgtttacaattcagacaaacttaacactttccttttaaaagcctccataaaagtctgcagccctctttgatttggattgagttttgaagccttcttctctgacagcgttgggtttctccattttgcattttccagtagatcttggggtctgtcctcagtcaagacacctgctgctgggactgccagtcgccacatgcttggctttcatcttccctcgtgtctattcatagcatgcacttctcataactctaaaagactgtttgatgccccctcattgtttaatatctacatgattaaagcagctgagagaattagcacgtgtcttaagcctaaggaaaaatccagtctaaaagaaattgtattgcaagcccagatcgtttttaataagctctgctgtgctctgtctcacctattcctctgtggggctcccttgggcattttataggtatttgagggttagctttaaaaggattctttcaggcatgtatttgactctcaatataacatttatcaagcccccacagtgtgcaggacccttacagtggtcccatggtaaggtacaaaagaagcaagcataccattttaacacttaaggaatcaagttacctgtcctttaggatgaagtgagggagaaaaagtgcacatatataaaagatttgggtacatgttgaagatgtcagatgtataggtgcaacatgagtatcaattcggtacacaaagggggcataaaatgaatgtgtaatcacagttggaaagatatagtgagagcctcagaggagtgaatggtgtgagcttaagggctttcatcatgagtgtcctcagggacttcagtaaggcaatgcaccgtgcagaaaagttggtattctgatagtgttatatgaaaataatagtaactgctactgtttattcaattgaatttttactttgtgtcaatgtaaaaagaatggaagaactagggagcaagacaatatagactgtaaagaaatacattcttaaagtgtcaattgtatgaccatgggttgaaatttggctagggaggtgggtgggccgtatgcttgtcgcgtgtgtctgtgcatgtctgtgcggggtatggggtggcagcggggaagaagaagcaagataaagagacttggagagtacggcagagtctgggaaatagaggttacggtatgaggtgacagcaattaaagtggggaaaggagtaaaagaaaagagaggctgtgttcaaagaaaggattcacagttccagatcttggaattaaatcctttaccttctgaatatatttttctctgaaaccttaggcttattttgctcattcagaataaaatagaatatttaactttgaaaatagggtttttacagaaaataaagtgcttctttaaaatgctaatttttgactctcagagtatgcccaatttttccacaaatttgtaatccatagtaattctgaggcatagcttatgggaaattaggatgctaaagccatgtcagaaaactaagcaagtataaatttacagtaaattattggagagactcacatcactacattagcacatggtttagctgtattttgacagtggaaaacctggcataagagtctctgggagcaccaggtaatatgcctgaggtccctttcctgcaggtgaattctctagtggcagctatcgcaatttatgccagaggcttatttttgtgcagacataatctctggtagaattttcgcagcctctgttgacagaactgacagtgtgtataggcccaggctactaggcaacaccagcatcagttagcagtcagcaaatatttattatgccttaaccatatgcctagaaccaagttagaagcaaggaggatatattagaacaggcataaacaatcccctcagactctttacagggctgacatacttaaagtaactaaaatagtgacaaggctatatttaatcaaatgccacattcgagggagggtgagtattttaggatgttagaaaaaggagagatcagttagagcactagattgggagagtcttcagaaaagaattggaactcatcctataacgcataagacaggtcgaatttaaagagtaagagtgagaaaaggaaggaaatctatgcacattgagaacaattcagaggaaggcaaaaaacaaacaaaacataacaaaacaaaacaaaaacaccctggtatttatatagtacaacaggagaccagcttgattgacatggaagatgtttgaaatcaatagaaaataagttaggtcgggccagagtatcaaagtactttgaaaaccaagtcaaatgttttgaatacaatacattaagaaatgggagacgtgtgatgatgaaaggtgggagcatagcatggtcatttaaggggcattttagcacaattaatatggtactgatttactggacaggttggagagggtagagaaaggtatacaaatattactatagctattggataagcacatatttaacttcaatttcacccttcaaggaagtcattcaggccattcccaacaaaatcctagattcccgttgttttttatgttaaacataaaagtgttaaaaagatctaagttcacatcagatgggtaatgtgccaaagttgtaacaaggtttgaaagaggcacatctcacacataaatatgaaaacctattgtttgagtcagtttccaaggctgaagggactatatgcacttacatcattggataaaatctctgtgtctctaattagcttcaatctgtacagatgttctttaaggaattgccattcctttttattagaccgagctcacaaatttttccatctaagtttgatgtagtatgttggaaatgactattctaggaaacttggaatgtatgaaaaatatggaggttttttaagaaaaagaaaagaaatatgtgtaagtaagaggtaaaaataagcaaaccaaaataacttagatggatgaacccaaacctaggttgtagctgaaaatagaagggtaaacaagtgccatcccaaataaaaacaaactaaagtaagaaaatgggcaatgcagagaaatcaggacataaaccaagtttcacttgaattatgcataaaaattaagacagttatttcagttttgattcatttgcttgtgtatacacttaggttttcacctgccaaactttgtaagttagtataaaattgatcatatttacatcatcatcaaatgacactggttgtcagatttgagggaggaaaatatttttcttaaaatcattggagattaagtctcaggaaagctacagcctcaatgaaaatcttgtaaatataattggtattaagatctgtttaattaaatggcattacaagggaaaagaaggtcaagtttgtctttaggtatttgtcttttgctttcctcggttatttccctacagtgcaatttattccatttagactggtggtggttcaacactggctgtaccttaggatccctatgggaactttcaaaaagtccactgcccagactccaccctagattgatccaagctttggtattttccagagctcctcgggggattctaataggtatgccgagttgagaagcactgtattagattagcaccagcatctttctctcttcccccctcatatagtcccttaaggcataacacttcttacaagggacatatattttagccagactaaatatttgtgttacactgatgatagaaagctcttgagggcaggtccttggtttgtttatttttctatcactcagtgggctctggccagtaaagtttgttgtattaataccaagtacaagtataagaggtagcaggattagaaatagggcccaggacaggctagtttttatgtaagtggggaggggaagaaaaaatccagattgtaaaatacagaagtcttggctatagtgggaagtcttcaataggtcctgtgaatataaaatatcaccttagaactatggtttattgccagattttttagttatccatactgtgactttaggtaaggtgtttatcactgggtgtctctgatatctctttaaaatgaggaaaatagttccagtcccatctaccccaaaagattgatgtgagattcaactgacatttgtagttatgagttcattttacagtatttttaagtataatatgccagatatatgtaaaattgttgtcgttatgatttacaaaggcagttaatagtctttttgtcagaatgaaaaacctagaataatccacagagcactgcaagtgcctttaaccaccaaagtcagtggaagtgtgaggaagacttcctttgcaaagctattcaaatacctcaaagattgtattttctataatcccaagagatgagtatgtccatgtagaacattgcataattttgacagactttaatagtgcaatgaaaataatcatagcgaaataacttgatgtgaattcaagttccagtacagcattaacttggtttatgagcttggataacatatatgtatatgtacttgtgtgtgtttattcattaaagggaaggagtcagtgtactaaaatttgttaaaatcattaatctatctatccaacgtacattaattgaacacctattatgggtcaggcagtatttttagtgttgggaatacagcagtgaaaagaaatagacacattgcttaccatcatgtaaacttacattctagtaggaagtggagcataatataattccaagtctatagaattgctattgaaaaaaataataaaacagggtaggcacatagactggtggaaaagggtaaaaagagtggatgtttcataggtgccaagatctaccataggcacttcccacacgttacttttatttataaatcttcacaagcatcctatgcaacaggtattgttatcttcattttaaggagagggaaattgaggctcagagagtttttaaaacttgcctaacattacctagtggttatgtgacagagttagaattgcaacttgcatctgcctgagttcaaatcccatgttctttctactacatgtggccagcacgtaagtgacttagtatatgtttccatattcttttctgtacaattcctttctgttgggcttcatcagagatttaatctgacatcccatgtaccctatatgttccacagatactaacactttaaaaattgaattagttattagcatttaaaagtaaaaagctgcatatagaagtattggtttccagcttgtctcaaagtattgaaaagtccagcaaaattgggcctgtgctcccatagggcagaaaccagctgaagctgagcagcatgatccctctgagacagagcatgcactctctgggtttccacagccactactaatccatgttgtcatagctgagccacttcattcatttatgttatttacctggcccatgtaaatatttgaatttgtgacccactagaacaaatacatgaaaaaccctcttccagttccaaagttttgattcaatgctgaacattcgggctcagttataagccttgtaactattcctttgacaacttagttatacttaaatgagtttttttctttcatttcttctccactttgtttatcttttatggtttaacaaccatgcaaacaatagccaaaattgcacattaatttctttactttttctattttaaaatatgattcagtgcagcacacacaaacctatatatttttagtctttatgcagaaaaaagtgaaacatgctaaacatgttaaaattctcaagcatgcatataaactgtaaatagcataattaacaagtaattcataatggcagttaaattctgccaatgtggaatcatgcaagccagtttagaagtccatgttttagttaagtctataattcaccatagcctttaaaatccaagtaatttattaacctaatataggttagaagagaaaacccagtcataatattgaagtgaatatagggaaagatgcctctcatgaaaatcattcaaagtataattattcttaagcacaacattattaaaatgtatttctataatataaaagtttttattagtattctgtgatataaggtaccctatgcagcattatgttaaattctgtctccatatttataagttttatagagtttattttatagcagtaaacaatgggatctctgctagactcagagtgaattacagttgcttaatggtgtgggtacaagttgatttgtcagctcacaggcccaattatctgttcttgtggttgccctagagcggccctgaggcacaatagcctctatggccaggatatctagcttgttcggtggttcatacactgttagtacatgtttgatttcatgcaggtggagtaggagcccacttcgatagtgcacagtgaagtatggcatgaagactccttcctcgtccagccacaaatgtcttcctgtatagcctgccacaatgcctgaaatttccagcctcaaatagtcatttctttggttaaattttcatccctgtccggaaaacaaaaccacttcaaaaaggttaagccattgtcccacatataaatagtgttggcttcattaacactatgaaattgttcattggtttgcataacaaaatgtcatggtccctgggagaacaggtaacgcagagcaggtaactcttaaggacggaaataggaaagtttggtctaaatataagatatttgccaggaaggtcatgcctagcacaaagctctgtggtagagagccttgaacagtacatacttggttgggggcagggtgttagagataaaggaaagaaacgttagaaaagagaaggtgaaagtgaaataaggttaaatttgacatagttcctgccaccctcttcctaggtccaatcctcatgttatctgttgcttataaatttaaaagacagttagacttcagatagtatgaatgcttgagaaatggggcattataactgaaagatttgttagtttagattgaaatgtattataaaataaaagtaccagtaaatttgcagatttctaagaaggggtttgataagggacaaaaagtcaattcgaaaattaaacaaggaaatggaaagaagaataaacaatgtaagaatattaattcatttaatttttgaattgacttttccccgttatccatccactgtccacagtaatttggaaacaaactgttatttacattttataatattgcattagttttctattgccactataacaacttaccataaacttagtggcttaaaacaacacaaatgtgttatcttacagttctggatagtcagaagtatgaaatgagtctcaccaggctaaaatcaagatatcagcaaggctctattcctttctgaaagctctaggagaaaacctgtttttcttgcattttccagcttctagaggctgctcatattctttggctcatgatctcttcctccatcttcaaagccagcgatttcatgtctatttgatccatcttccccgtcatacattctttgatacttctgcctcactcgtctacttttaaggacccttgtgagtacgttgggtatacttagataatccagaatagtctccctatcttaatgtcaacggattattaactttaatttcatctgcaaccttcatttccctttgccatgtaacctaacatatttgtatgttgtgggtattagaatatggatgtctttaggcattattctgcctaccacaaagataataaacatacattgttatactatgattaagacattgtgtttgttacaataatggaaatgggttgacaaattttattcccagacaaaaccactcagatttacgcattttagctaagtacatatataagtgacaaacattaaacaaaatgatgaaactgtttcaaaataaaggaacagatgaagatatgccagggaattttcaataaggagaggatagggcaaggatgtcaatatcagattaagtggaatttaaggccaaaagcattaaaatagaacctagagggattcattccataaacaaatatttattagatgtaactgtatggaatgatatgtgaagcatttgataaaactgcagttacagttgtgaaatacagatttctcagaatttgaaaagtaggcaaaaaataataccaaggatttgaataattatgaagcttgacctaatattttgtcaaataaatagaattagatactctaatgccaaaaacaaaaccacatttgtattttatgcccctggaccatttacaaaatttatcatgtactttgccacaaggaaaaccttaataaattctcaagtggaaaactggcaggtaacatcctctgacaagaattctgtaaagctagaaatcaacaattcaaagaccagaaaaggtaaacaggaaaaaacttagaagaaccataaaatactttatgtaagtaatttttggatcaaagagaaaatcaaaagaaaattttaaaattatttaaaaatgaacaaaaattatattacttcctaaataatctaggaatgtggctaaaaacatgagagctgcaagtaaaaaatatatgtgggattttcaagactttgcacaaaatatacatttaaattaaaatttattatttctttaaattcatttaacgctataaattttccttatagcattaactgaatttaaagaaatattgaaaaaaatctttcaactcaggaacagaaaaagaatatatagatatatatttcacataaaagtatctgtacaaaagtaataaaaatataagctaaaataattacaaaatttcaatgtgcaattaacaaagccaaaagctggtctgcgaaaatatgtataaaagaggcatactttgttctacactgaaaaatacactgatatacttcctaaatctcaaggataaagagaaaatctttcaggctttttggcagaaaaactgaatcatctacaaagaaaaaaatggttttctcatctatatcgtggaagctagaagacagtggaatagcatctagaaatttctaagagaaaaagactgcaaaccaagtaacttaccatccagtcaaggtatcattcatccacttgggtcagagaaagatgtttgaggacatgtaagaattcaaaaagtatatcactctcatacaccagtgaaaaaatatttgagaaaaaactcaaactaaataataaatgaatcggaatggagacttcaagatgagagaagaaacaatgatgggcaatgaacctggctctctggaaaagtaattaaatctaaatggaaaggcagattgacttaaatatctaaaatagtatcatttcaacgtgtaatcaatataaaaagtattaatgaaatactttgcattcttcttttgtgctaagtcttaaaaatcccacatgtattttgtacttgcagtagatctcagttcagactagccacatttcaagtgtacaatagtcacatgtggctagtggctaccatatggacagcacaagcgtctaaataaatatactaaactatcccaacaaaacacaggagtgggagtgagaagaagggaggactaacaagatccagaagatctcatggggttaggaagagaagtgagaaggattataaaagtgacattgtagggttaacaatgacaacaaaaggaagcaacttggatgtccagcaatagggcattagttaaataattaatggtacatttataacatataacatttaatatttccagattttgaaacaatgagttagaagcatattctatcttaaggaaacatgcatgttatattgttatataaaacaaacaagtatagtataatacataaaatacccaattttcataaaaataaatggaaagttttttaatgtgtctgtttgtatatatttttatgggtctagagaaaggtatggaaagaccttcactctacaatgagtatcagttgccttgtgacaagattggagaagttagatagggagttatttattaattttgtctttatgaacaactgtattattttaattgtaataatgagaatttgggggggtaatttctaaaacatcttatacagtataaataagaatgataaagagaaataagcagcaatagctcttgatgtgtggaagggacttgacctctgttcataaagtcagacaaagcctgagttgatagcattatttggtcattaaaagaggggcgtgagatttaggggaaactagaggtaaggtctttaaaaaaaaaaaaaaaaaagtcttgttatataaagggacttcctaagtgaagcatgaaacccagaacccataaaggaaaaaaaaatgacagatttgataatgtaaaaattgaatgcccataaacaacagtaaggggggatgggaaaacaataggttgggagataatatctggtacatacaaaatgcaatgtatatggatagcacattccatataaaaatgaaagaattacacaataccaataaatatatgaaatgatgttcaaattaatagaaagtaagtataaatatatataaataaaaatgaagtaactttttcacctaatttggcaaaaggaaaaagaaaatgattcaaatatttactgtaagggtatgaggaagctggaactgtggggggaaatatgaactagaacaattttttatgagaatctaataaaattcaaaaagcacatgcattgtgacccagcaatcagactttcaggaatttatcttacagaaagaataaagcaagagtgcagaaaggtgtatatgcaaggatggccattgaacattgcttataatagtaaatacttggaaataagctaaatgtgtggttctggtcaaataaattatagtagcctcagacaaagaaattccttgcaaatatgaaaaaaagttaagtagatctacgtgttctaacacaggaaagatatccatgacatactattgagaggaaaattgcaaaacattacatataacattatctcagtcttgtaaaaacacaaaaaagtgtttatgcttatgtgtttatgtatttatgtgttttctgcatttttcaaacaataaataaaaacaatgaaagtatagtaacctttcagtcagcatgatgtttagggaatgaggaattttcattaatccgtattttttttgttgattcagaattaatcatatatttttaaattcccatctttaattgttgaaaatctttctaaaatgactccttttctaccccagtgtgacatcgaggaagcatttttgaaccttcattctatgactgatcatctttagtgacttatgttcattattttgagtatcggttctttttgcctgaagccctaataataatgacaattgctacatttatagagccaggattcaaacccagttctctgatgccaagttcttttcagtacagaaaagcccctggtagctaccctcattgattaaatccctgaaatgatgtgtttgcttttcattcacttttattttcttacagtagaaagctagagggaaaaaagtcatttggttgaaatttttggtttgagtttcaataattaaagttttatgtattcaccatgtagcttaagaaatagagcattactaattacctttttgcctctgctgtgtgatcttttcagatcccagccctcttccctcacttccctactagatgaccgtcatcctgaaatgtgtttatcattcccttgcttttccttatagttttgccatgtatgtatgcatccctaaaaatatgtttttcagtttcatatgtttacaaatttcttaaatataatcatattgtgtttctatgaattgctttttgtgctcaatgttacattactgacatgcatccatgttaatgtacatagctcatttattttcaaggttatataatattccattgtgtgactgaaccataatttatttatcctgtagtcttttttgtagactatcatggcacagctttcaattgatcgaaatatcacagatatcacaatctgccaagaacctacatggccattgtgatctgtctgttcagtgttgtagcgaaataaatagacaaatcagagtaccactataaggcattcaatgagtatcaaataaaagtttgaatagggcactgtgagactatggagagggccaggttaactttggctaaagcgaggcttagaaaagagataatttgaagtaagccttgaaaaactgttacaactttcaagaggtagatatggggaagtatggctttctatgcaaagaatcactggagctgcaaaatgggaacataggacaatgttcagacaatgtttagcatagatgtggctggagtgtaggtacctgaaggtctggcttacccagtctaaatgggaacagatctgtaatcaaatcctagctccattttttaaaaaattgccaatattacttaacatggcaggttacttgacttgaccttgttctctcatctgtaaagtgaataatgcctacctctctgagtcattgtgatgactgtatctttaagtgcgaaatatatggataggtcttcgcacagtgtctggcacaaagtaggcactttcttaatgtcagttcccttctcttatttaacattgacttgaataaggcctctttcacttttgtttctcaaggaattgaatgggtagggcaatgaatagtatttttttttttttttttgtaatttctcttcaggctcagagcctcaccatgacattcctttgcttctgttagaaaactggttactatctggctcaaattttcagcctcggctgggcgcgatggctcaagcctgtaatcccaacactatgggaggccaaggcaggtggatcacctgaggtcaggagttcagtaccagcctggccagcatggtgaaaccccatccctattaaaaatacaaaaattagccagacgtggtggcacgcgcctgtagtcccagctactctggaggctgaagctggagaatcgcttgaacctgggaggcggagattgcaatgagtcgagatcatgccactgcactctagcctgggtgacagagccagacaccaactcaaaaaaaaaaaaaaattcagtatcttctttgtgttgtctccctctaattcctacttgcaaatatcaattcctgtactccagaaatagcccaagctaggatatgaagctcaggccagggagtctgggtagaaaaaggaagaatgtagagaaggtttctgtttgtttaacctgagctaagaaaccagcatcaaaaacagagcttcaaattgagtccacatcttatgagctagatgttccctttctatttcatttctagggacaaagctgatgtcagagcgtagagaattctaagcctatagattacctggctatcatggaagagtgatgagcaaataatagtcaagtggctttatttcatttgataaagttgagaaaagcacataacccagtgaatatactagtaaggagcagaaatttgcacagaaaatgaatgaattagacaggggtgttcagagtcaaattatatcaggaggcagcaaaaaagggaatgaccagctagcagagcaagcacataaacaaggcatattgtagttgaagagatgagaagattaaaaatctataggagaatttatcacaactcaattcagttcaatagataattatcaagcactgattgtgcaccaggctttctttggtcctgtggttgtggaggtgatatagtgaaggacagtttaaaatccaagtcaaaaaatgagaagcaggaagtctatgtggggttaaggaatgagctacaaacattcattagcagagacctgatcctgaagatactttgctaattcatctctaggccaccacttctgatatttgtattagtcagaactccgacagtgaatggtggtagcccaactccaactagcttaagagaaaaaaaaagtttttttggctcaagtaaccaaacaacaaggtggaacatggtcttagcaaaaactggaacacaggttggagtcatggactggaaaactgtcaagactcccttgtattcctacctctctctgcaggccagctttattatgtacaagatggacagctggctactgctgactgctccgggctgtcaaccttacagcctagctaactaaaaggaaagagatcctcttctgcctgctttcagtaaacatttaaaaaattaagaaaacctgaaaatgaacctggattggactagcttatttcccatatcaatatctggactaatcagtggggacagggaggaggtgtcttggtccattcttggtttgttttatgctgctccaaaagaataccatagactggataatttataatgaacagaaatttattggctcacggttctgaaggctggggagtccagtggctaaagatgtctttttgtgtcatcacatggcagaagggcaaagatgaggagtggaaaggtagaaagagagagagagagagagagagagagaaagggggtgaactcgccattttataatgagcctattcctgtggtaacaaattaacaaacccattcccacaataatggcattaatccagtcatgagggtgaagccctcatcatgacccaatcgtgttttaaaggtcctactttttaatactgttataatgacaattaaatttcaacatgagaactgcctataatcacagcactttgggaggcccaggcaggaagattactttaatccaggagtttgagaccagcctggaaaacaaagtgagacccccatctctacaaaaatcttttaaaaaatttagttgggcatagtgatgtacacctgtggtcccagctacaaggaagactgagttgggagaatcacttgaacccaggaggtcgaggttacagtgagctatgatgatgctactgcactacagcctgagtgacaggacaagaccagatctcaaaaagaaaaaaaaattcagtatgagttttggagggggaaaacattcaaaccatagcaggtgggaaatatgattggcccagactggatcaggtgtccaccccttaaacaattataattgtggcaaagactgcaatacaaaggtaggagcttttcagatcacaagtctaaaatgggggtaaaacaatggttttttttcaaagaggtgagattgcagtatgtagatggtcactgggggaatcactgtaagccaaacattccaccatgtggcagttctgttgggtaggagtctctccaaacatgaatggtctagagatgctgaaagtagggacatgtatttggaagcaccaggctaaaatggagaatacatgtgcagttgggatagcagcagatttttgacaggcagttctgaaccacctcaagcctttggttgttctctattgcctgtagaataaatcctgagatgcttattaagaccttcaaaatcttttttccagtattttctcccttttttccatctgtatgaaccctttaaaccagccagacttgaatatttactgagcaaagcactccgtgtgaagctacactcatgcaatcatcagtcctccagatatggaatcatcattctttatggtgtgtttctactatcatccttgcttagaatgcttttgagatacactgctatattcaccaaatatttatttatgcttctatgtgtgcaaagttttttggatactggttatacaatgatgaacaagacagacatggtccctgccctcagagaatttactttttttctttttgagacaaagtctcactctgtcacataggctagagtgcagtggtgcgatatcggctcactacagcctctgcctcctgggttccagcgattctcctgcctcagcctcccgggtagctgggattacgggcatgcaccactatgcctggctaatttttgtaactttagtagagacagggtttcaccatgttggccaggctggtctcaaactcctaacctcaggtgatccgcctgcctcagccttccaaagtgttaggattacaggcgtgagccaccacatccagccgagaatttacattttagtaggagtagagagtttttatgtaattataaaactgatcctaaaattatgatgtgatgactgtgataagtactccagagaaagaaggacctaatctggtctggagggtcaaggaagtgagatgaaatcaaatataagaaagaattaaccaaatgaagagatggaaaggggcaggaaggagaagaggaacaacatgcacaaatgtcatgaggtgaaaagtaggatggcgtatttgagaaactggaagaagtacatgttgcagaagcaagagagtgagtggccagagaagtagacagggaaccaaataacataagactttgtaaagcatgttaaagattttgatatttatcctaaatgtaatgggaatatactgaagggaggtgatgtgattagtttttagcattctgtctggtagcattgcaaacaatagattagagggtaacaagattggatggaagggtaccagttaggtcattgcagtcatctaggccagagattattgaatgtgaaaatggaaaaaactgtattggctcaagatataattagaagataaaaatgatggtatgggggatgcctatgtttctggcctgtgcaaatgaatggatgatacttatattcacaaaaaggcaatggtaaaggaggatcaatttgaaggcagtgataataaagttagctgtggacatttttaaaaatgtaaggcgtcttttaaatatctatatgacaaatgaatagttggatatacaacctggacaacagtactggagtctaaactctaccctctttcattcaagccttacccattcatcaaatcctagcttaatctaccaactccacaagagtcactgacccatttttctcattctattcttcctctcctctgtgccctctcctagtgtttattgcctgaaccaatcattaggttccagttatatactctacaatatatatggggatatatgttgtttccattaccagacattaagtttgttgaaattagagatccatattagattacattatacctccttaccaccagcagatatacatgtagtaagagatcattttacctgtaacgaagtgaatgcatagcctttctgccactaaagcaatattagaagcaaaaggtgttaaatacaaacaaaattggatttgaattttgacttcacctcttactaggaatggtgaccatggtcaagtattttaacccttcagagtcagtttccttgcttatcaatacaagataataatacatgcctcaggaagctattgttcagtattaaatgcagaatgtatgtaaagtgtatagcacagtgtttgccacaggacaagcactagaataaccattatttgttgttgctgttatgactattattacttttgtggagatcaaaaaataccataattacatatgacaagcagtggctatggtgaggtgacaagttagtgaatacaaaaattggtataagcatatgcctgtttctccatactttatagtatagtaagattttccattattctctacttcagaaagcagtcataattttgttgtctttatttttggctggaggttggcctctggttttatagaatattccactggagccagtctcttgtgttacataaagcataaattaaggtatggctaaattcacaatgtgagaattgtgtgcacatgtgtatatatgtatagacctatatacctattaatcatttttatcaagaaggcccattgctcacagtgtgtaccatatattggtcattatgttgctggcaagcaaaaagaaatcacccacttaacaggagagaaacacattaactcttcaaactagtagggggtgcttttactaaattacctcctccagttgctttaatggtaccctagtctccacacactaatgcatgtctgagcagtaagtagttttctgtcaccttactaggagaactaggatatttcttttttaatatgaagagcttggggagagggtgtggaagttcgtttttttctttatatttgtaaaatatttatttatggaatcactatgggaacgtatataaatgtatagtagatataaattgctagttctatttataaaaatccagtatctcttttaagtcaatggtattagtaagaaaaaaattatgatcaatgtttttccaacttttacattccagtgcatccaattttatatttttttactaattcttaatggaaagaggttcttattgaaaggtacccttggaatctagtgatatttttaatataccagtagatgatatatattttagttttatatatgaataattataattcaaaatggcctttccagttagctttcttttcacacctctcctaaggcccatttgaattttatgtagtttaagaaataaaactgatttcctagatgaatgaaagttgtctttttataattttagcccaatgctaaaatcaaactgttcgcaagtggactgtttttaaataaccctacccagatttggaattttcagagcaaatactatttggcatttatatagcacaccctttcaagactggacttttatttattgattatacgtcatgaagtgaacagtgttacacttataattttatagctacactgtagagtaattcaatttttcttcccccaaccccaccccagctccccatctctgaagtgcatggtgattatggtgttgcaggtgggctctgggttgactagaagagctcttccccccaacaaaataaaactctctccccaaccctttctccatccctctttcttgctccctctctccttatcccctctctcaggatattgagtttccaagtatttagccaaaaatattttgggaagaaaagtgaacacacagaacagggacaaatgtggcatatctcagcatagtctcccagggtcctcaacttccctcaaatggaggatactgtacagagaagccattgacatggttttcacctagtagatttcagttcgatggaagaagctaaattcctacttgtcactgctttcatatactcaattttgctgaccctctggaggaacctgagttaataccgagatgaaatgcacagacaataacatatagattaatatacagatgaaaatctgtgtgattctgatactaaattttgactgagcacagttattacaaatttatttccgctagaatatgagttccatgacggcagggatttttgcctgttttgttcattgctttatctctgatacctggaacaatgcttgctacgttaggtggttaataaatattttctagttaaatgaattttcttacattctggattaaaactcacagctagcgaatttccaggctgctttgtagatgtatgcaaaaaaattgtaaactcggttatttgtgttcagattaatgattctggagccctagcacacaggaatagtaagcagcatgagatataatctaaggcaaacaaggcccaattccttagtatggtatataaggccctttacaaactggctccatcccactttactggttcttctacccctacacttatagtacagatgcagaaaattgtttgctgttctttaatttcattattcccttacacttgtctttgcccttgaacacacacttctctgtgctagaaatgctcttatccactttttaacctaccagaagtgcattcatcctttaagatgaaactcaaagtatcacttctctggagcctgtctcagtctttcaggcagagtgagtccctcactttgcttagactccacagccctttatgtatagatctatcacggcacttacttacctccttgtcctatcatcatttccatgtctgcaatagattgtcagcccttcgagggaagaggacgtatctttttccttctctctaatctgcctggatcctaccacagtgtctgtcacaccataggtgctccgtgagtgcttattgaataacatatggactgagggcatgaaaactaagggttgaagtgctctattaaaaattataggccaagtgccgtagcttatgtgtgtaatcccagcactttgggaggtggaggcaggaagatcacctgagctcaggagttcgacaacagcctgggcaacatagtaaggccccatctgtataaaaaattaaaaaattagccgggtgtggtggcacacacctgtagtcccagctacttgggagactgaggcagaaggatggcttaagcccacgaggtcaaagctgcagtgagctgtgatcgcaccactgcactccaaagcctgggtgacagagcaagaccctgtctcaaaaaaaaaaaaaattataatatataatttggcattagtcagggaagagaaagtataccaaacctagcttaactttttcagattcgctaacatactgctgtgctgttaggcaactggccaagaaatgagaacatttgaacaagaaagggggaaaaaacaaatggagctagaattctggaaaaggaagtgaaaacggccaaagtaattgatgctgaatatggggagggagagggtgacagacagtggatggacaaaaggaacagatctaccttaaattgtgcctaggagaaaccttggaaccagtgacaaagccaagtaactatgtcaaaagtgaacatttagccaagcatgtgttttgtcaatatactatcaaatcactatttggctctttgtgctttttccccccaaggtgatgatttggggaccaaatggagtcaactgttccaggcatcatgtagactcatattacatctatcctgtatatcattaatgtccttgggcaatcctcatagattgttttacctgcacatccttccaaaatgtgtaaaaggaacatgcattcatgtatatagattgtccattgttttttaaatgcctgaaacattaatttgattgttcagattaagtgtttggggcaatgataataaggatttggataatataagtttccagttcaaaagcactaatgtcattgttgctgtttgcatttgctttctagctttgagaggttttggaaaatgcattttgcaagaattgcctgcagtgttagcactaaatgatagtgtggaggtaaagagaagcatgcctttatctaatttcatacctccttgataaatttcaaataaagaaaaatgttcctaaacattttaccataaactgtagaatattttcaactcaaagcctttctctgtgtactgtgatacgtgtaaaactctgaatgtagatcacagatataggcttagtctatttagcatgagatgataatactaccttgtaaacaggaactgcccccaaaatttgatctgattgcttcctctagttgggtgataacatgctgaagtaataccccaacacacatttctcagtgaatattattcctctcatctttgttaatgttgttaaataatttcaaaactctcctcaaggcagctgctctgtgctagggagctaaacacaagagaggccaatgttttcttttatttgtccgcctgcagacacagatgttgtttgtgttgtctggaagcacagaatatgctctaaaatatcattgttgttttcaatgagtcaaagtgacaagttgcgggtaaagtgaatccataagaattagtacagagtggaataatacttcaaaaggaggtacaaaaatgcattaaactcatatagaacaataagctattaatgatatatgcatagtttaagggtctatttttatattgtcagtgacaaaagaagtgcccattgtctcctggctgctatatccctcaaagtattttggcggctggctgtggaaatccagatggagacagcagtgaactgaatgaaacctgggagacaagaagcaggaagttctagcatccgccacattcacattgcacaaatgaggactaagctgtgaatttgaatgtgctgcttataatatgctgcatgaggtcattaggatggtgttaaaatggttccaagttagcattgccagttggtatctgtgtgactttggacaatttatttaatctgtcattgaatgttggttgctttatttgaaaaacaggactaataagctgggcacagtggctcaagcctgtaatcccagcactttgggaggccgaggcgggcatatcacctgaggtcaggagttcgagaccagcctggccaatatggcgaaaccacgtctctactaaaagtacaaaaattagccaagcatggtggcgggtgcctataatctcagctactcaggagcctgaggcaggagactcacttgaacccgggaggtggaggttgcagtgagccaagatcgcatcactgcactccagcctgggagacaagagcgagactccatctaaaaaaaaaaaaaaattggaataataacaacctttctctcagggctactctgaggattaaatgaaataatatatgtttcagggcttggtacatagaaaatgctaaattcatggaggtcaagctaccaaggaacatgcagttttacatattaaaaaagaggaagaagaaagtaaatccaaacattaatttagcatcttcttttttaaaaaaatttactttaagttctgagaacatgcacacgtatgtttattgcaacactatgtacaataggaaagacttggaaccaacccaaatgcccatcagtgatgggcactggataacgaaaatgtggtacatatatatcatggaatactatgtagccataaaaaaggatgagttcatgtcctttgcagggacatggatgaggctggaaaccatcatccttggcaaactaacacaggaacagaaaaccaaacactgtgtgttctcactcataagtgggagttgaacaatgagaacacatggacacagggaggggaacgtcatacactggggcctgtcaggaggtagggggctagaggagggagagcattagggcaaatacctaatgcatgcagggcttaaaacctaggtgacgggttgataggtgcagcaaaccaccatggcacatgtatacctatgtaacaaacctgcacatttggcacatgaacttaaagtaaaataaaatttaaaaaagaagatgctaaattcatgtttggatttactttcttctttttttgatatgtaaaactgcatgctttttgctagcttgacctccattcatttctgccccaggactagggaatgcgtgctttgaaatcagaactacctagaagtggttaaattaaaaatcttgtgcttagtcagttgcaagtgaattttctgataactgagataagttagttttccaacttccacagctaatagagaatggcctttctttctaaataaaagtttgtaatgataggactgtaatgtaaataccactctcaaaaataattgtgttggttcagatctactatacttcagaatgaggttgactgaccctgattataagagtatatgactactatgttagtgtttgcatataataacccattctgccattgactatatatgctatgccactaaagagtctttgtagaaattaatggtaaacaaagggtacattatcaacctcttattgttgagaagtagattctgagggttttttaaataatagggcttcatttgcgctgagttaaccatatcctctcatctagttcttggaaataaatgacatgcattcaaccagaatgaatagccaggattatgagagaaatttgtagctatgggacaaaacaaaggcaactagactgttaaggtggaaatggcaaatgtgtcaccgatatcattgagtctacctaatctgtcatggtactttatcattgagcccagattggcccatgaatctttcctgccagattaggaataaacctcatttgttggtcatgtttgcattagtctgtaccaatctagccattcaggattttggtatccagaatttaagcccttcggattcccctggagtaaaagtaaaatggcagacaagttgagagaaattgatctgtccatttccctcattgatgacagtgtgtgaacacagattggtttttctgttttatcagccttgctgctttgtttcattgttcccagtgttcttcttggccatttaaattaggcaagcagagtacattcttgtcttccccctgtattttctagaaacatctttattgaggtaaaattgacatacaataaactatatatagagtatacgagttggtaaattttacatatgtatatatccatgaaaacatcaccacaatcatcacagtgaacctacctaccacccctaaaagtttcctttcactgctttataatgcctatatcctccactccccacacaccccagtccaggcaactactgatctgctttccctcactatatattagtttgcattttctggatacttacatacctggaagcacacagtatgtagactttttatttggcctctttaactcagcataattatcttgatatttgtttatgtcgttatattatttatattaatagatcattcctttttatgtctcagtagtattccattgtatggatgtaccagagtttgcattcatttgcctattgatgttctttatttccagctttggctcttacaaataaagcttctatgagcatttgtgtacaaatctttgtaaggacatgtgattttatttatctttggtaaatattgagggttggaatagttagatcatatggtaagtgtacatataactttataagacatgaagatatctagggccaacattgctctgcacccacctaacaaagcttaatagcaagacccaaaaggataaaaatgttgccaagtaatttaagcacacactagaacaaagctttatacgcaaatatatacagacagtccccaacttacaatggttcaacttataatgattcaacttaatttttttttactttatgatggtttaaaagcaatacacattcagcagaaaaaatactttgagtacccatacaaccattctgtttttcatttttggtatagcattctataaattacatgagatagtcagcactttattataaagatagcctctgtgttagatgcttttgctcatctgtaagctaatgtaagtgttctgagcacatttaaggtaggctagactaagttatgatgttcagtggattaggtgtattaaaggcatttttgacttacaatattttcaggttacaatgggtttatcagaatgttaccccattgtaagtcgaggaacatctatctatgaattcaaaatctgttttgagtattctattcaatgcccatgaattatgaggttttccactgtggatgttggaaacagtgactatttccagccctgtttcagattcagaagttgtttcttttattcctttctgatggctctttctccattctcagatggttttcttgcacgcatgtgctgtccagagtgcaggtgaatatgcaggggggaccctctgaagatctatggaattctttttctgtgcagttctctcctctctggtactccgtactgcaaactctagctatcttggccttcccgcactaccagcttagtcttctcaactcaaagagactaccaggctctacctgtgatccccctccttgtcctgaggcctggaaactcttacagggtttacctaatttgtttctcatatctcagggattgttgtccttcattatctgttgtccaatgcctgaaaactgttgtttcatacattttgtgtggctttcgttgttgtcatttaaggcaggagaataaatttggttgctgtcactccatcttgtttgcaagtggaagtcttctccagaatttaatgttttcctctgaatggaattcaaatttgcaagttcctgatgagtgtccaaaaagttattttctcaatctttcccaacttagaaaatttattcattcattcattcatttatttatttatttatgatgaggtctcacactgtcacctaggcttgagtaacagtggtgcagcctcaaactcaggggctcaagtgatcctcccagtctctcaagtagctgggactacaagcacatgccaccacacctggctaattttttttttaattgagacagagtctcactttgttactcagcctggtttcaaactcctggctcaagcaatcctcccaccttggcttcccaaagtggtgggattatagtcaagagccacccacatccagccagaatttcttttttctatccctgacttattttttttagtaacattctctgagttcctgaaaacaggctgtcagaagagctacatacccactccagggcattctacaaacttactgagatgataaattctatctgggatatggcatgaaactggttgatgagaatgacaaaagaagtttctattcaagccagcttaaagatggtcttttaccaaggctttgtgactagtttcagtaaaatttccccagttctacaccctagagtacatttctgaagaattttaacaggcaattatttcccagttcattatgccaaaaagtatagtgtagaaagcttcctttgtgtgactatttcagtcagaagatgatactgagtacttgttctccattagtctaatattataaattgtattttcctgaattcacagccagtgggctgctgtctttctcctcttgccaaatttgtggaacatctgttatttgaaacagacagctaatttaccaaaataacaatttttcaatttgcattggtaggcattgttttatgttaagctaaaccacctcaaatgtgtcagaattgggttcaagttgttaaccctttcaagagtggttccatgttaactactaatttttaaactttggtgtttagggtcactctttgcctagaagtagtctaagttctgaggggatggcaataccaccttagaatgtaatttattctgtagttgatgatggacgctgactctgttgtaccattctatcttggcatctttactcattcatcacaaagtaaatgcttacagagaagtatagaatgttacagaaataatattgcttgcctctatgagtatgtatttgaagcactcacaagtgtttttaatggttatttaactctagctcattgatctcacttctctagatagaattgtgcagcagattgatgtagtttaaaatttcagacacacacacacacgcacacacacacgcacccattgaccaaaaagctgcacatacttagtgaacataatggaaatacacaagtatacctggaagaccacaatgggcaacaaggattcaggttccaacgagttatgaccagccagaaaattgggccagcacatgtaagaaatgagaaatttttagggccattgagcaccatgcattttcagtgttcagtagccctgaaaatttctcatttaggccaggaagtctctgtctcattcaaaatgttgaaataaagggaacatgcacaggttctcattgatctaaatttctgttgaagtccaggacctcccaccatcttttctagtccctgattctttttccagactcttattacaaatattgtagagcaagcatccaatttttgtcattgtagtggtaactgctgagttagcttcaaaacaagtgctcccatcttatgtgaatacagtctaaatggagccgttcactaaggtgaaaattagtttaaggaaatagttagcatttgcttattcccacatcaaattttcttcctcttcttagattgctgaaggatattttaatctctctctaaatatgattggagttgttttgatttcttccaggtttctacctcgtcttctttccttttgagtcctgatacaattctgtgtcctctgatttgagccatttttacagatttttaattcattgtactcctgagagcatcctttttttgatattaacatagccttttaactgcattctgggatgtctccagttagctaatattggtcacaaagcatgaatgtttctacttcaggcttttaactctgcccagatttgttgccatgcttttccgtatactgacagatggagaaatcttgaaaattaaataaggcataattagtaggtcctgagtgccgagataatgggtgcatttggaactgtcaaggggagattaggctccaggaagcttagttattttatttaagtcatcttataaccacaggctccagtcttgcacatgggagcattccatctctcactcctgtgccccagaaaaagctgatgagccctcagcagaaaaataaaagtcaggtttagacaatgtgcctttattaccttgttatcattaggggcttaaaaaggctctgtgtggaacttcccaaaggacatgacaaggtcctgttaactcactctgctcactgcctagtatagcactgtacatttgataaaacattttcatgaagaaaggaggaaattaaattgaactaattttctaagactaagagaaatcagaggagactattttgttttgatttctttactttaaattgagtgggtgttcagtgaagctgtgtttaagtaaatttacttgaactgatttggttgacaatttgataccgttttctttttaaagccctcaaactgagaaatagaaaatggtacccagtagtgaaaattatttgcctcttatctggtgttacttacttctttgtctctgtatttcttgcttaagattgtaataatccattgcatttttccctggagccagtaatgaattattagtgggtcagtaatatttttaattgtgtgaattttattcattatgtttccaatagccatgttgtaaatggatacttttatatttgatgagtaacaatttactcagttgctttttacattttaagttgtagattctctgtttctctatcaataatcttgcaattcatagtaggtacataggctgtatcaatactttaatatagcaggaattataattatggcacaagatcttatttaactaatatgtactatatccttcacaaagaagtataaatggctccttgattcatgaaactactaactcttttcccatttgaacacattgaccattacatatgttggataacaggttcgggttataattatagaattttagaacaaggcagttacgtagagatttatttctagttggatccatacatcttacaaatgagaaaactagcccccaaaatgttaagtgacttatccaaaaaccaaatggataattaataacacttgcttctgcatgtaatctataagggttgttatgagtcacagtaattaaactaataattctatcccctcccccctctcctttattttggaaatgggctatactctttaaaagttatatcccaaatttctcaggtcatggttaaaattaatcacacttcttgacttccaattacttatttggagcataatgccttaaagctcactttttagaggaagcatggggaggtagaattttagaaaaaatagtcttgagcttatcagaaacacagaaattggccgggtatggtggctaatacttgtaatgcttgagtccaggagttcaagaccagcctgggcaacactggggggagctcttctctacaaataattttaaaattatctgtgtgtggtggtgcatgcctgtagtcccagctactcaagaggctgaggtgggaggaggatcacctgaacctgggaggtcgaggctgcagtgagccaagatcgtgccactgcactccagcctgagtgacagagtgaaaccctgtctcaaacaaacaaaacaaaacacagaaatggcatttctagaaaaacactgatacagatagctataactttccttctcaagttttgataaatggcttctttaggctgaacacctgatgatcaacccctagattcagaaagtagagtcatttatttttttttcagtgcttcatagcatttaaaaaaaaattattaatttgttagcattagtagatgtctaaggtggtcctatgtgccagaccagctctactcaatctcatgatcctcaaccataaatgtttccctagctgctgaaagcttagcagtgatgagtttcatccttagtttccctcctaaatttgatgttcaactcttatgtgtctaggacaaaagtacaccctagaagatcactgagaaatcatgcatcagtcgggcatagtggctcatgcctgtaatcccagtactttgggaggctgaagcagatggatcgcctgaggtcaggagttcgagaccagcctggccaacatggtgaaaccccgtctctactaaaaatacaaaaattagctgggcatggtggcaggcacctgtaatcccagctacttgggagggtgaggcaggagaatcacttgaacccgggaagtggaggttgcagtgagccgagaccacaccattgtgctccagcctgaacaacaagagcaaaactcaatctcaagaaaaaaaaaaaaaagaagaagaagaagaaagaaagaaaaaataaatcatgcatcagttagtcttcatggcctcttggcttagatataagcaagatgacattttgactacctttttgttcgtgttacatttactttattccactagagagaaaagagcaagacctccttctagctgtgaaaattgattcaaaagtctccttgttgttttaatatctggtggtgtacaatcaactaaaaatctttgtaggggtataattgaagtataataaactacacttactacgtatacttaaggtgtgcaatatgataaactttggcatgtatacacctgtgaaactatcaccacaatcaaggtaacggacatttagatcaccccaaagtttttttgtgtcccttgttatccatctctccctccacccttttccccaggcaaccacgtattggctttatgtcacagtagattagtctgaattttctagaattttatataaatggaagcataccatatgtagatttttgtctgtcttctttcacttagcagagtcattttgaagtccataacattgttatgcatcaatagtccattcctttttaggactgagtaatattccattatgtaaatataccacaggtggattatccattcatgtgttcatagatacttgggacatttgtactttttagctatttttgaataaagctggtatgaacaactttgtacagttttggacagaagttttcatttctttgtgataaatgtccaagagtccaattgctcttttggtaagtatggctttaacttttcagaaaactgccacacttttttcttatgtggttgcacagttttactttctcaccaccagtgtatgagaattgcaattgctccacattctttctcaacacttcttgtgggcagaattttttttagccatagtagtgggtatgtagtggtatctcattgtggctttagtttgcattttcatggtaacagtgatgttgagcatcttttcatttgcttattggccacctctattgtttgttgtgaagtgtctctttaaactttttgcccacttaaaaaattgaatttcaaccattgcggaaagcagtagggcaataccttaaagagctagaagcagaactaccattcgacccagcaatcccattactggttatatactcagaggaatataaatcattctaccataaagacgtatgcactcagatgttcattgcagcactattcataatagcaaagacatggaatcaacctaaatgcccatcaatgacagattggataaagaaaatgtggtacagactaggtgtggtggctcacacctgtaatcccagcattttgaaaggccaaggcaggaagatcgcttgagtccaggagttcgagaccaacctgggcaacatgaagaaaccctatctctataaaaaatatgaaaaattagccaggtgtgatggcatgtgcctgtaatcccagctactcaggaggcagaggtgggagaatcacctgagcccagaagtcagggctgcagtgagccctgatcacgctgctgaactttatcttctctagagaatatgtagtactttaggtaacaaggttatatgtacaaggctagaaaacaactacttgtggtgcgttgtaagtgctttatagataatgcatcttttgggaattttgagcaccaccaagacgtttgtgtatttaggaaaatattttacaatggtgacattgatttcaagaaaaggaaatgaggcatttcaataaacatcggttactataagtaagtgaaactttttctcttttctttttttatgctttaccacttaaaaaagaagagcaactgatagctaatttggattgttactttttctaattatagattgacaagaaagtgtacttttatctgactgtatttaattagagaatttatgagtcagtctttgtaggcaaagcaggatatagttacaatagaaaataaattgtttattctatgtaatttttaatcagattacacagcattttcttagaagggagcaaatccatgttctaatttccttttgaatgggaaaaatatctctttaataaaaaagaaatctgcttacatctgtcagtgctttttaaaaaactttatctggtgttttattaatctggaatgacaaattggacctacatttatttttatttgctcaaccttttccaacgaatgccatgactcagatgctcatattaaaatctttggaaagccacatctcatatgccgttgtatgagtgaaactaaatgcaagtctgtgctcttggaagtaaattttctagttagtgccctgaatccaggggaaataaatggagacacttcacagcaattcagagcaaaaactccctttcttgtatctttaaacagaattaaagatgatgcagcaaaatctgtggtaatgccatgataagtttgcaccctcactactacccattccctggatcccatccacttcaagtaaatctctagggcagtcgatttcaaagtatgatccctggaccaacagcatgggtctcaccagggaagtcattcgaaatgcagattctttggccctactccacacctgctgaatcagaaacttaaattggaaggcacggatgggagtggggtgcagcaatctatgttttaacaagccttctaggtgattctgaagcagccaagtttgagagccactgttctaggggagtgaagtaagttgttacagacctatataaaattcatttcttgcagcttcaagctgaaaggtttattaccaggttgctgtagcaacaactgcacagtaggattggataatgaaacattgtgaaattaagaggcatgaatattagctgatcccaatattctagattgctaaaatttatattgggcaaaatggatttttacttttagccttatggcaggaagaagcatggtttcataaaatgttatgtttgacaagtggaaaccacgactattttttgaatactactcctttggaatttagccaagtttttgtagaaaaagggaattactcttaaatacattcatcatggaaatcaaaaggtaacatactcagcagtgacttataaccctgaaagagttaatttttaattgaatatttctaatacattatagtagctttatttgcctactatatgtttcacaaagcacagtgctatgcacctagtggtattaagtaaacaataagaattttttgttaaacccttatttggtaattatatgccccaaaaatagttattttaaaaatatattcatattctgcttgctttcctctagtgtatggtctaaaatccagtactttctgtattcagagaattaaattcatgttagagtttgcattttattgatatgtgctaaggattagatgcactcagttaagctccttcccagccaaatgacatatcctgtctctgatgtcagtctgagaaaatcctgtatggtgtactacatctccggattaccttatctaagtattacatggacatttcagatgatatgtcttggcatgtggtcatttttcattaacttattagcaattgttaaatcatcttttcccctttttgacaccttgctataactgaatgtaaaattgactgtaagactgaatgcctgatattcatgcagtaagttgatggggcatcgttgttgtataccagaaaccatgcctacatgggtgttttaggaaaaagggctctgttgctatctgatgtgagctatgaaaaaataatatctatcctctggagtttattttcctcaactataaaaagaaggaattcgttgcatcatctttaaggttctgaaaattttataactctaagatctagggggaaaggagaggaaatccaatccatgaaccactgccaaggtacaatatatgactaaatttttgtgtgtatttattggaaaaaaatgaattacatagaataattagcataaagtcagccttgaactccgttaaaatcaatggaaaataatgatattaggtactgatgatttagagtttaaattaacatgttttaggaaaaatactttagaaaagtgcatttgaacttaatgcttttttctcagagttttcacattgaattatttattcttaaatccaatgtgtatggaatacttagaaaagcaaatcattttaatattttaagcataggtacactctgcagatcatatatattcttcctagaaaagaaatatcttttaaaggacacctctctacactttatactcctctgcactcacttatttcattacattttgtgaaacctaaaattgtagctatagaactattttgggcgcgctttttccagaaccttgtaagaatcaacaggagcataattttaagctacagaagtgcaaaataagcacagagtcctagctaccatgaataaaaggccagaattctaacttgcaaaaacacgtaattactaccaatgggggagaggggaatgagaacaaaaagtagaattttctgggggatttcttcatacttctaaacgttttctctgaactttgtttcttctcagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtaataaactacttgaattgtttaagtaaaacacagaaagaatgcagtttttagcctttgctttgttctccttccctatatctgcccttctttcatttaatatgcagaatggaaatacaagttagcagggactcatggacaaggcatgcacctaagtatctggcaaatagacatttatttataataacagacaaaatacttttcattttcggtgagcccccaagggaaataatctcatgtaatccataatatcgtgcatgttttgtttattactcaccttttattttcatctttattttccacggcaatactagtagaatttattatagaatgtccaaatttcatgtattttggctttatatcaataaatgaacagtgagatgaacagttgtgtagcaagcatattctgtatgtgcttactatttggattcagattaacctgttgaatgtacaaacgcaaattaaccaggttggactgaagtggtttaaaaaaccagaaggtgaatgaacatcatccatttgcttgacaataaggactagcagcagtatcattatgtcataatcatatatgattttcttgcaacttttataaaaggaaaattttgtctttttgatttgttggaaaggggttaatttattttatttctgttcttttgctcctaccagagaacaaaatcttttcataaaaagcacattactgcttattaaacacattagtctctccatcattctgtttgtgtacattttataagtccccattaccatgaccacaaggcttactctgttaacagtggtaattagtactttttcaggtggcagagagatagccagctgccctgtacctgcagtttgttttttctattttgtcctcttctgcctcctttaatccaaaggtgatactggccatataatcaggaattagaggttgcctactagttagaatatcacgtcctaaatagtagaccataacactttacaatatcaccaagtatccttggggtcttgattttttttagattattttcatatatgtatgtgttcatgtatgcattgttgactttggccaagagtataggaagtaacgtacggaaatgagaggggaacatatttgacatatgtagcatattcatgtaagtgaaaggcattaggatagaagttaggagacctttgactggtcactacagttttctgggtttcgtctttcagttgggaaaaacaatgatcaaaattatatgaaatggggtggtaggtgatctcttatattggcaagacatcttctccttcatctcactctggacatattcactgggttgaaacattaaaatgaaagaagtttccccactgggctctgctattcttctacctttgcaagtctcttgttatgaggtatcttttggggtgatgaaaatattctagacttagatagatgtgatggttgtgcaactctgcaaaaatactaaaaaccactgaattgtatgctttaaaaggatgaatattacatatgtgaattatattgcaataaagctgggttttttttaagcaccactagatgaagggtaagggttgaagtttgaggaattgcagatgacttggacaaggcttaactagtgaaatgtttactgttacaggtttcaaattctctcctgtttgttgtgacatggaggctcaagctgggtctactcaaggcaagtgttttcaaatatttgatcacaaattatttttacttcaccccatccctggcaccctacccccacaaaatggaaccctgcttctctgacaaacaacatacaagcctgctcaatgaacctgtcagagaatacagtggcagcttatttgtttgttttcttcttgaaaatttcatgtgaaaatgttggtggtgaagaggaggtgaagggggagctagggagaaggataaaacaggattccaggtaggatgagaaaacatttatttaacctgggaggagagactgaaatcaggttgggttggatttggcttcatgactttctacaaatctaccatgttttacatggctctcataattaactcagtatagtttaggtattgtcataactttcagatgttgcctagcagttggccttggtctcttcctccaggtgttcatgcttggctttagcatcacactttatccatgtcatcaatcataaataacactttcaaatgaaaaaaaaatgttcattctcttctgtaaacctatatttacactgtgtcattccttagtaagggggcattggtgtatatttttacttttgccttcattgtgttcattgggttttgcccctttggagagggatactactgaaagtaacatttataaatggttttcacaactgggcctgtgctgggcccttctctaacacctcgtggtagggtccaagcatcccaccacagggcagtgactcaaaaatgggatgaaactagtatataaggatttagaacagtgtttttaacatgtaggaagaatatgaatgttcactgttattattggattagcatttcaaaatttccaaacacacttttcatatctttatcccatttcatccttatgaccactctgtgaaacaaattctattatttccattttacatatgaggaagtattaaaacagcaattcagaaacaatctagttgaatgcaatggattattttccaagtatgctttgctttctcctttggatcatgtgtgtatgcaatatgtaaacttgaacaacttttccctgctctgttctgtatgtcttactttgactcctactaatattttcaataaggagtatataatttgggtccttatttatcacctatggtaagattttaccaatgtggattccacagattttaattgatgacaaccatgcctggcctgccttcagcatttccatagatccttgaggagttggtttgagttaagataagagtgtaaatggcttttccaaaagcatgttaatttgaggaaacaagttatttccaatgaatgaacttggtgtttgtgtggaaatgttgctatttatttcccattgactttatccattcatgaaagcatgcttatcaaggcatctattttattaatttgagtttatacatgttatatctgaaaaagtaaaactacttagaatattttttatgtatatgttttgctacctcagactccatgccagcccatccctgtggctcaattaatgttaatgacattttgttttgtttctgtcttcatatactttctgaattttagattatcgatgaggcagtgggcatgatatcatggatcagcttaggaacatttgagcctcacttgctctgaatgttagaaaaagtgaagatggaggaaattgttaatttaggtgaattgtccaactgagaaatattctgagaagtaatttcaaagatgcttactattctattcatcctaggagaatattactttggttttctacttacatttccaaaatcatgtttataaggacttgtttcttttatttcattaattggccaagcctttcagaatttttttcctcatttccttaactctgtttggttgcccttaattgaatttatgtctctgacattttataactcatgaaggattataagaaataacccttaatttcaacactaaaacacttgaacttaaaggcctgaagtactggaagggaaatcatcaggtgacagaaggggatctggagcctttcacaggggtatcagagcactaatgcattatgtttccattctctcaaatttgtcctaagtaaacccttcatcatctgttgatgctgaattgtctgtcaagaaagatgcagattcattcaagttagcttcattctgggacctgtgaacagtcaatacctaggtgatactttgatatcaaccatcatgctttattctatgtcatttttattcccatttcaccttactaacaacattactactcttcatagactaatactagagttgtgtattttatatcctaacaatcattgttaataagcactagactggaagctacttgaagaaagggtctaatttattcacttttgtagcttcagtacttagcaaggggacctagagcacagtaggcactaaataaatgaaaaatatgcattgttctaagggtaaaatatattttttgttgatcttgtcttgtgtgactctcataaggataaaagtgctacagtgtgtcagacctctggtcatctaatatacaactctgtctctgacaggtgatctaatggtcatttaatttttttatctttagttatgggtacataataggtgtacatatttatgggtacatgtgatttttttttttttttgacagagtcttgctctgtagccaggctggagtgcagtggtgcgatcgtggctcactgcaacctctgcctcctgggttcaaatgattctcctgcctcagcctcccaagtaactgggactacaggtgcacaccaccacatccagctaactttcgtatttttagtttagacaaggtttcaccacgttggccaggatggtctcaatctcttgacctcgtgatctgcctgcctcggcctcccaaagtgctggggttacaacatgtgatgttttgatacaggcatacaatgtgtaatcagggtaattagggtatccatcacctcaagcatttatcatttctttgttaggaacattcctattccaatattttagttattttaaaatatatgatgttaacattgactacagtcaccctgttgtgctatcaaatgctagatcttattcattctatcttactatatttttgcacctattaaccttccccaccttttcccccacttccctctacccttttcagcccctggtaaccatccttctactctctatctccgtaagtacaattgttttgatttttagttcccacaaatcagtaagaagatgacgtttgtctttctgtgcctgacttatttcacttgacataatatcttccaattccattcatgttgttgcaaatgacaagatttcattcttttaatggctgaataatattatattatgtatatgtactacgttttctttatctattcatctgttgatggacatttaggttgcttccatgtcttggctattgtaaatagtgctatgatatgtttcctttcttttgcatgtatacatagtagtgggattgctagagcatatggtagttctatttttagttttttttagggtacctccatactgctcttcatggtgactgtactaaattacattcccaccgacagtatataagtgttcccatttctccacatccttgccagcatttgttattgcctgtcttttgggtaaaagccattgtaactggggtgagatgctatctcattgtagttttgatttgcaggtctctgatggttaatgatgttgagcattttgtcatatacctgttggccattcatgtgtcttcttctgagaaatgtctattcttttgcccattttaaaatcagattatttaatttttgtttcctattgagttgtttgagcttcttatacattctggtattaatcccttgtcagatgggtagtttgcaaatattttctcccatctttactttctaataagcatttcttagaagactttgacagtcctacttaagtatcaacctcagtgattagggtacccctcagcagttacatttggctacacattgaactggaggaaaaaacagtatcaacagctaaatttgaataatcaatttccaagaatgtgtttttcacatgtggcctgaatggaacagttgaactataaaatgtgaaaataaaaattgtttatcaagaagctaaatggaaacacattttctaggtagtgaaaaagtattgtaatctttaataaaatataaattgcaaataaattatttatagttatagccttgatgataatgatatttctgttcaagaaatatttattaagcaccttctctttgccaaactgtgtactagagattgggaatatatgaaagatgaataacacacattccccaatgtcaaggaatttaccgtctactgggagagattgatgccctattagttaagatcgcctattatgggtaacaggaatcaacttgagctagcttaaactgaaaacaattgtattaaaagtacataagaatacaaggtgactgtagtcagtaatagtctgattgtacattttaatataactaaaatagtgaaatatgatcagttgtaatacaaaggataaatgcttgagaggatggatacctcattttatatgatgtgattaatatgcattgcaggcctatatcaaaacatctcatgtaccccataaatatatatacctactaggtacccacaagaaatacaatttaaaaaaataaagtacgtgagaatgctccattggactcagggcaagagtgtggctataccacaagaagggacttgttgcagtcccttaacaattctcagaagaattgttaagaccttgctttttgttttgaaacccatctccttcaacactgtctctgcaggttgagtttctctaagtttccatctacaggacaggtataaaaaccccataccccataaaaccttagttcatatttcttctattcaggaaagaagctaagattaaccagattttttttagtgccatttctaaattccaaggagacagaataattttctcaacttgagtcagctgtctaccactggtctcatcagctacaatgaggggtaaggtcagtaatacaaatgttgctttctggaagcctacccaattgattctcgaagcaattcccaatgcagggctgtcagtgtcaaatggatatgtatacccaaagaggtctactagagaggattgaaagctaattttaatacactttagttaataccatgataaagatacggtagcttgctctgagagcacaagggatgtgaaaccatttagtaacgtaaaagtggtaatattaatacaatataaataaacaacgttttctgtatagtaagtggttaagaataaccacgatgtaagacagacctaggtttttgcactagttctgccatttacctgctatatgtccttggacaggtaactaaagatctccaagtcttagtttctttatctgtcaaatggtgactgcaaagtcttgggagtttttgtggtgaggattaaatgagaaaatggatatatagcactttacagtgtgtctgttaaaatgaaatgctctataaatgtcagttgtggttgttgtttatcactattaatttattatgcacgtattatgggacagatgctatcaggtaaggtacctgttatcacgtattagacaaagaggcagcatagcttctgaaacacctaatatcccagggaactctttagcctagcagaacccagcctactttctgctcattttaaagtaggtaaaaatccttgcacttgtcttattttaaataatacaacattttattaataggcaacaaccttgttctgctaaacttagaagactgtgagaggaagttccctgaggcacttcagacctggctgcaggttaacttgtgctgttgtatttcccgttgtcattgtagtaaccctttaagggagaggtgggattttaattagtactcagaagtcctgttgatttccttgactgttgggcggctgagctccctatgttgttctgttcagcaactttacaggtaagggaatatctgatacaatctcataacagccaagaaatccattagtactgctccctgttgcttctgtactgcataccacagaacctaagtagtgcggtatgtgctaccaataaacataccatcatagccatgcatatgctgttctcagaccctaaattcattcaaggaaaccgctggagttgtgaaaaaaatggctagcctaatgcctgggtttcttgaatgacatgtaatagttatacccaaatgatgagttatttcttctgatatttgaccatgtacatttgatggagggaatttgtttgtttgttttccatttctttcctttgctttttttttgttttcccctggtagtgtaagttatataggacccttacatagcagtgataacaattcctcagaaaccatctgattgctaaaggaagtgtatgaaacaatgcaatgacttggtaatagcttcagcaggagccctgccatataactgacatcctaatggctctgttggacccattaggcgtgtgtgagacagtgcagttgactctgtaacagctcctttggagatgttacactatcagaggaagtgtggaagtgattgggattactttatgtgtgggtgagacacttctgtggtgactgtgatattcaaaattaaaaaccactttgatgatactgaatttcaagccattatcaaggtagatataacaagctcatattttctttttcagtaggtaattttagctactattatctttatgttaaagtaatattggccagtgatttaaaaattaatagtaaaaacaggtttaaagtgaataaagtgtatcatccccctccctctccatccttcaggtttcactcttgagacacagtcaggttaataatgtattatatataattccccaaattttccacgcatgtacaaatgggatcacatactacaaaaagtctcataattttttccagttcatattatcttggatatttccccatatttgtagtacaaatctgcctcgtcatttttaatgactgcataggattctgtttatatatgtgttattttttttagccagtcccttgttgatggacatctagatttccagtgttttgatattaaaaacagtgctgcacttaatatccttgtacacatcttttacacacctcttgtataatttattagaagtagaaatgatgggttgaaaatatatgcatttaatgtttgtttagatattaccaaatttcccccttaaaaaagacctaccaatttatttacctactaaagctatataaaagtgcctgttttcccatatacttatcaacactggcaatgatgagaaagatttctaatacccaatctgcaatatgaaatacagtatttcttcttgctattatttgttctatttatgggtgaccttggtcatctttttaatgttaatggcccatttccatctcttctctcaatttcctgttgacatactttgcccactttcccatatgaatttttatattttcttattagttctctagagtacttcctatattaagggtaaaaaaaaaaaaaaaaaaaaaccttcactacatattatgcatttttcctagtgtgatatttgtctttttaagtaggtgcattgtgtgtgtgttgtgtgtgtgtgtatatgataagatttacatttttaagtggtaaaagtcaactatttgtactttatagctggtggatctctctctctctctctctctctctctctctctatatatatatatatatatatatatatgtatatgtttttgctagcagtactataatttccacaatttgaaaaataaattgcttaaaaatttaatttaaaaacagaatataaatatctacacataaataataaatgtgaatgtatggtatgcatatgtgtaatatataatacatacatatggatatatttacatgaaagcaaacttgaatgtagaagttaaatacagtacaaataacgtagctattaaaattaattagtattttagaagttagtctttggagttgatcttgatatattatttactctcttacttctttagtatattactgtgaaagaagccaaaatgagttaaagtgctcttatcaacagagttttaaaaaagagcttagaaaatgaaggaaaaaaatatggctgagcctatattcaccagaaataaaatgacaacattgtcatctgaatttgaaaataatgtttcaattgccatagttaggacttatgcttttggttgttcttttctggtttgggaatgggctcatgttaagtcattcgtgttaccttgcactgtccatcttttcacttttgatagatattcatgagattgctggtcagagttaattttttgggtaggtatttaaagtggaatgcagaatagctcacaatttgaatgtgtgcagttgaatttgttttcatatatcctagttgatcattttttgaaataattgaaataatatctttagagaaaaggggaatcatcttggctacttcagaggcaagttgactatcttttcagtagtttttttgttataaaagtaatattttttaataaatagattattaaagaaaattgggaaattactgaaaaacaggaaaaaatccttaaggttctctccaaaataaaatattagtcatattctctcatgaattagcatcttacctttttctttccgtgcatcatgtgtccttatcaggatccatacaacctgatatttcacttaaattaaaatgtgagcaatttccaatattactaagtcttaattaaatgttattttaaatatattaattaggtagatgtaacataattaactatacactatttttgaatattaacatttccagtatttcactagagcaaaaagactaaaatagacatctttgtaatcaaagataggtctctttctgatctattcattattagtagagttctacaaataaaattactgggttctaaaatattttcattaaagttcaagatatatattatcaaattatatcaagattcatactcccccattagtaaagcatgatagtggccattttagtgtaccctcactgatactagataatttactttaaaatatttttcaccaatttgaaatgtgaaaaatataactacagtcatgtgctgtataagagtgttttggtcaatgacagaccatatatatgagaatggtcccataatataataataccatatttttactgtaccttttctacatttagatatatttagatgcataaatacttagcattgtgttataattgcctacaatattcggtgaagtattaataacatgcttacaggtttgtagcctagcaacaataggctacacctatggcctaggtgtgtagtaggctataccatccaggtttgtgtaagtacaatctgtgatgtttgcacaatgacaaaatcccctaacgacacatttctcaaattgtatccgtgtcgttaagaaatgcatgactgtatgttgtttaaaattacatgtcattagagagagaaaggaagctagctgactagaggcatctggtacttacctcctccacaaagaagaaccaaaatagctagtaatcacacttcaaatacatcatctatgggagaatgctagaattcagcaaagaagtgacaggaagtacctaaggcaaggaaaaagagggaagcaaggcagcctgctcagctggaatgggctggggacctggaaaagatccccaatatgatgaaaggataagtgagagaccccagcagtctcactgtgaactcctgcagtcctagctatggagaacccttgatccatgtgggccctgagactaacatagggaatatgcctggagattatgtgacggcattgctccagagagagatgtcacattgggtctcaccccccacccacccccaaatcctaaacagctacagcatgacaccattttgagagctcggtctccaatagacagcatcctgccctgggggtcaacatcctctgcctctacacatccctggagtacaatgaacatcctctgcctacagccaccaccgcagctggctgctgctaccagggtcaaagtatgagccattggaagcaaccccactgcccccagcagtggagcctcttgcatttgcaagcaccctaatgacaggctaccctgctgtagctactacccagggcaaaagtgcacactccctacctgcctgacaattgctgctgccactgaaaacaacctgtggctccctgatatcagggacacagtgcagccactgatacccctacccaagcattccaccagaggtctgggatcaccctacccctgccgaccacagtcagcacctgcatgcaccacaagaggaggcccttaatacagatctgcctggcccagcaccaccactaccagtgtccaagctcattgtccaggagagtgaggattgcctgctcagtccaccagtgttgacaactgagcactcctcccagaagcctcaagttgggccaacacaaccagttgataccaccaaagcttgtacccgtcagcatgcaccacctacagacctgggaattggcctgtccaacctgccacagccactgccaacacaagcacagatcacttggaaaatagaaggttgtcttgtcactgctactgctactgtccatgccacacctgctggccagcagcccaagggcccacccactcacttggtccactgctgcaattgccagcacttgagcaagctttctggaaacccaatgatcaacctgcctggacccactaagactggtgccagcatgcactgccttgaatgggcccaagaacaggcacacttggcctgccactgccaccactgcagctcaaggaggggcccagctggcatcctcatctgcagcaaaactttgctttagccttcactaaaaactgcacactaagccactgaggacatcatagacactactgatgttgtttacagctaaaggagtcacacagagatgacactacggcacggcacccagaagcaaagcaaaaattttctacccaaccaacatataggtatgtgttcaggaaaaagtcctcccctaccaaagcaaatacaaaaaaattagaaggagcaactgttatacctgatgcacaaatatcaatgttaaggacaaaagaaacattaaaaagcaagaaaatatgatacctcaaaagaacacaataattatctatcaacagattctaatgaaaaaataatttatgaaatcctgggaaaataatgatattaaattcagtgagacaaaaaattaaattaaattaaaaacccaggaatacagctaaacaaggaggtgaaagatctctacaatgagaattaaaaacactgctgaaagaaatcagagatgacacaaacaaatggaaaaatgttccatgctcatggataggaagaatcaatattgttaaaatggccatactgcccaaagcagttttacagattcagtgctgttcctgtcaaactaccaatgacatgtttcacagaattaggaaaaaaactatgccaaaatttatatggaaccaaaaaagagccagagtagccaaagcaatcctaatgaagctggaggcatcacattactcatatcagagaaaatagatttatgtcaaaaatactaaaaatagacaaaaatgtcatcatataatgataaagcaatcactttagcgagaattatgtaacaattctaaacatatatgccgccaataccaaagcactcagatgtataaagcaaatattattagacctaagaagggagatagactacatagattaatagttgatagactacatatgttaatagttgacttagacaccccactctcagcattagacagatcatctagagagaaaattaacaaagaaacatgggacttaaacttccctttacaccaaataggcctaacagacatctacagaacatttcatccaacagatacagaatacacattcttcttatcagcacatgtaacattctccaggatagaccacatgttaggacacaaaacacgactcaacaagtttttaaaaatcaacatcatatcaagtatcttcttatactacagtggaattaaactagaaatcagtaacaaaaggaactttggaaattgtacaaatatatggaaattaaatatcctccttaatgaccattgagtcaaacaagaaattaaggaggaaattttaaaaaatctcttcacacaaatgaaaactaaaacacaatatagcaaaacctaaggggttgctgggcttggtggttcacacctgtaatcccagcacttcgggaggccgaagtgggcgggtcacctgaggtccggagtttgaggccagcctggccgacacagtgaaaccctgtctctgctaaaaatacaaaaattagccgggcatggtggcaggtgcctgtaatcccagctactccagagactgaggcagaataactgcttgaacctgggaggcagaggttgcaatgagccaagattgagccattgcactccagcctaagtgacagaacaaaactctgtctaaaaaaaaaaaacaaaacaaaacaacaacaacaacaacaacaacaaaaactatgggatacagcaaaagcagtgttaagaaggaagtttatgggaaaaaaatgcgcacatcaaaaaagtagaaagatgtcaaacaacctaatcaggcaccccaaagaattagaaaagcaagaacatactaaaccccaaattagtagaaagaacacaataataaagatcagaacagaactaaatgaaatatggactataaaaagtaatacaaaggaacaacaaatgaaaagtaggttcagcagataaacaaaatcaataaaccattaaccaaaaaaaaagagagtagacccaagtaaataaaaccagaagtgaaaaaagagacataacaaaaactgatatcatagaaatgcaaaaggtcatcagagactgtcatgaacaactatacactaacaaactggataacgttgaggaaatggataaattcctggccacatacaccctaccaagattgaatcaggaaaatatagaaaacctgaacagatcaaaaatgagtaatgagattgaatcagtaataaaatgtttcccaacagagaaaagttcaggacagaatggtttcactgacaatttttaccgaaccttctaagaactaacaccaattctcctcaaactatttcaaaaagttgaagaaggtggaattctccctaactcatcctacaaggccagcattaccctgatactaaaaccacgaaagtcacaatttaaaaagaaagctataggccaatatccctgatgaatatacatgcaaaaatcatcaagaaaacatcaacaaaacaagtctaataccacatcaaaacataatataccatgattcagtgggatttatcccagaggtgcaaagatggttcaatatatgcaaatcaataaacataatacatcacatcaacagaatgaaggacaaaaaccatatggacatctcaatagatgtagaaaagcatttgataaaattcaacattcccctcatgataaaaaattaaaaacctctcaaaaaacaaggcatagaaggaacacacctcaacataataaaggttatatatgacagacccacagctgacatcatactgaatagggaaaagctgaaagccttttctttaagaactggaagaagacaaagatacccagtttcaccactcctgtttatcatagtactggaagtcctagccagaacaatcaggcaagagaaagaaataaaaggcatctaatttgaaaaagaagtagtcaaatgttctgtctttgcagatgatattatcttatacttagaaaatccttaagacgtcaacaaaaaactcttagatttgataaattcagtaaagttgcaggatacagaatcagtttgcaaaaattagtagcattgttatacatcagtaatgaactagctgaggaaaaatcaagaaaacaatttcatttgcaatagctccaaaaaaataagtacctagaaataaattgaaccaaggcactgaaagaccactaccaagaaaactaccaaatcactgatgaaagaaattgaagaggacacaaacaggtggaaagacatccgatgctcatgaataggaagaattaatatagtgcccaacacaatctacagattcaatgcaatccttatgaaaatgccactgtcatttttcacagaaatagaaaaaatcctaaaattcttaagtaaccaaaaaaagcctgagtagccaaagcaagtttgagcaaaaagaacaaagctggaagcatcacacttcctgacttcaaaatttattacaagaccatagtaaccaaaacagcatggtattggtataaaaacagacacatagaccaattgaaaagaatagagaacccagacataaatccacatatcatcaggtagatacaaatcaaaatgaaatataatcttatcccacttatcacagctgttattaaaaagacaaaaaatagcagatgctgacaaggtcgaggagaaaagggaactcttacacactgttggtgggaatgttaattagtataaccactattgaaagcaatatggagatttctcaacaaactaaaaatagaactactataggatccagcattcccactcttgggcatttatccacaggaaaagaaatcggtatatcaaagggacacctgcactcccatgattattgcagcactattcacaatagccaagatgtggaatcaacctaagtgtccatcagtggatgagtggataaagaaaatgtggtacatatatatgatggaatattattcagccataaaaagaataaaatcctgtcatctgcagcaacatggaactggacatcattatgctaagtgaaataagccagacacagaataaaaaatgatatatgttctcacccatatgtggaggtttaaaagttgatctcatggagatggagtttagaatgatagataccagaggatgggaaggagatatggggaaagatcaagaaaggtttattaacggttacaaagatactgttagatagaaggaaaaatttctaatgttcaatagcagagtaggatgattacagttaacagcaatgtattgtatatttcaaaatacctggaagagaggacttgaaatgttcccaacacatagaaatgataaatactcaacatgatggatacccccaaatacactgattggatcactgcacattctatgcatgtaacaacatatcacatgtatcccataaatatgaaaattttatttctcaataaaaacatttaaaaaaataaatgtcatccagaagaaaattcagaagctataaaaatattaatcaagcctggcagccttgaggaacactttaagaggacagaaaggcttagattgtttagttgtttctggtcttccgtgagccagccttcactctgcagctcatccttggccatgaggggatgacaacttgtagggttaggcacctaggacactagccccatctaaatcagttatatttgtctgtgtgtctgtttttgttgctataaagatacctgaggctgggtaatttacaaagaaaagaggtttatttgacatatggttcttcaggctgtacatgcatggcatctgcatctgcttggcttctcatgaggcctcaggaagcttttagtcatggcaaagtggaaggggagctagagtgtcacatgccagaagagagtaagagagggatgcctggctcattaaaataaccagatctcatgtgaactcatgaccaccgggagggcaccaagccattcgtgagagatccactctcataacccaaatacctccctataggcaccacctccaacactggggatcacattttaacatgagatttggaggggacaaatatgcaaaactatatgatcagttctccagtttgactctggatccccaccctcagacctctggatgagattgttcctcctctatagttctgtggttctctggactagcctcgtcatagctgcatcacactgggctttaattgtaagtatcccccaactagattgaaataaaacaagctgatcacagatgtatgtaaagaaattttggcccaaggtaaaaactcattaaatgtgtgaagcatgaacatatagttggcccttgaacaacaaagttttgaactgcacaggggtccacttatacatacattttcttctgccttggccatccctgagacagcaagatcagttcctcctctttctcctcagcatactcaacatgaagatgaagatgaagacctttatgatgattcacttccacttaattaatagtaaatatattttatcttccttatgattttcttgataacattttcttttttctagcttactttattgtaagaattaagtatataatacatataacatacaaaatatgtgttaatcaattgtttgttattggcaagtcttccactcaacagcagaccactagtagttatgtttttggggagtcaaaaattatgcatggatttctgactgtgtggtagtcggcatctctaacccctgcactgctcaagcgtcagctgtactaataaacctataaataaatcagttccaagaagttctatgaatgggtttcagagagtctgtgaatgcctcaaattgcatgtaatattgaatgcactctgatagatatgcagtcctctggcaaggatccatgtccttcattagattataaagtagtccatgactacctccaaatacccccaaattatcttaaattccttgaatgagtatgtgggccaagctttgaggtaccagtcactttcagaagtcacaacttatattctagagagagtttattttgttttggaaaaataagcactgttaggaaccaatggaaaatgattaacctctttcaagtcaggggttgaaagttaaaagagcagaatatcattacttaccaactgcagccaaaaaattacaaatgaaaatcaactgccactgcaattaatactttgtctctatgaatgggtaacatggtcacctctgtggaggaaagtggaaatctgaagatctgcagtgcgttaattgaacaaatattctttctctgaatgctatattgtataatttggaattttttcctctgtatgatcacctatttcaaaataaataattataattttttaactggatgtcctttattgattctggaatttaacaatttttataatgactttaaattttcgtttgaactggaatgattttttaaggaaactatgataaaatctgagaactaactaataaattcaagaaccaattcttataggcataagcagtaaaatagcagaatcaggaaaagaagagaaaataagacgtgagtatgtcgaaataactaaagagacagaggatattgaatgattcataagagaccaatttgtgcacctcttttaaggtacccttgaaaaccatgttggaatggataatctcatagaaaaaatacaaatgactaaaactggtctcagaagggagagaaaattttctcagtagagaaagaaatctgatttgtaaaatagaaataaaacttccaaagaactacttaaaccaaaagaagtagcgtaattaggcagtgtcacaggcaaaatttgctacatctttaaggaacacattatttcaatgctacttaaatgttttaacagcataattaaatgaaagcttccaaatcttttaaagatttttttggaagcaaaaaaaattgatatctaaaagttaaaaaaggaaagtacgaaataaatcttcaaatcaattttacttctgaataccgaagcaaaattcttaaataaaatactagcccacaaggtccagcaatataacagaaaaataatacactacaagtaagtgcagttcatactaagaatgcaaggattattcaatattaaaaactctgttactctaacataccatatgagtacatcaatgtagataaaccaaatttaaaaacggcggagattttcaaaagggttttgataaaaaccaacattttatttaacaaatgtgtttattctgtgccaaacattgctctaagtattttacaaatattgagtttaatattcataaccgctccataactgaggtacaaatgatattcccatttacgatgagaaaactaaggcacaataaggatacataaaatgatttggctggtaagtggtaaagtcagtatttacaccaggcagttcaatccttgcatttacccatgatattatactgtctgtcatgcatcaatttttgatagacatacatacaaacgtatatatatatatataatttcttagaataagatcatgtaaaatcacaaaatccagttttatttgaagtgaggaagcactagaaggattttttttttttttttttttgagacagtctcactcagtttctcaggttggagtacagtcatgagatcatggctcactgcagctttgacctcctaagctcaagtgatcctcccactttagcctccggagtagctgaggctaaaggtgtatgccaccatgccatggctgtttaaaaaaaaattttgtagagaatggatgtcccctttgttgaccaggctggtgagctcctgagctcaagccattctcccaccttggcctcccaaagtgctgggattacagttgtgagccaccacacctggctctagaaggatttctattagagacaagaacaaaacaaggatatccgctctaattaactactttaaacttatgaagtagcaactgtccacattagaaaatagaagaggaataaaattagaaaaatgaggtataattttattatttttaggttatataattgtatatctaaaaaaaaaaaatctaagaccaaacatgaaactaatacaagaaataagagaatttagtaagctagttgggtataaaattagcacaccaaattaatagtttccttccatacaaacaatacttacttagaaaatatagttgaataaatgattacagtagcaacaacagcaatcaaaatgcctgagaataaacaagcaaaaagtacaacacacacacacaaaaatcataatgctattgaggaatatagaaaagaacataaataagtagaaagccatacttttttcttaaataagtctcagaaccataaaaattccccttaatctatcattttaacatgccttcaataacaaaatatcaattggtcttataaaaagcctaacataccagctctaatattcaactgggaaaaacaaacataagaatactttgaaaatatatggggaaaaacataatataatgatgatagatttgccagatattaaaatatatttaagttcattgtaaataaattagcggggtgctattatatgaataaacaaagtgttaggatggaagaagactggaaatggttccaaatacaaacaggagtacagtatatgataaagatgacctttcaaataagtctggaaggcataaattgtttatgaaaagtgttgagacaattatgtagccatgcagaaaacaataaagttgcttccctccgtacctcactccctacaccagaataaattctaggtgacccaaaattaaatgtgaaaataagtactataaagcaatatgggagaatttcttccaaccttaaagtaggaaaaccttttctagatatagcccaaaaaactagaagccataaataaaactgctgtcaaatttgactacacaaaattatatacatatgtatatatatgtatattaaaatatgtgtagcatacagagacagtcaatttcctcctatataaagagtgcttataatcaataagaaaaaaatccaaataatgtaatagaaaaaaattgatatatgccatagtaaaggaaatgagaatggttcttggacatatgaaaaaaaatgtttaaactcactcctaagagaaatgcatattaaaactgaactaaattttatcatttatcacctataatattggcaataattaaaattttataacatacatttttggaaaatgtgtatgaaatattgattatggaagtaaaaatagatacagtcgatatgaaaagatatttgacaatatctagcaaagacaaattatcttctttgatccagcagtttctcttcttgaaatttatcctacagatattgaatgagcatgcagtggtatgtatgaagatattcacttagcactgtttgaaatatcaaaaaatcagtgatatcaatcaagatgtttatcaataggaagccacttgaataatttatggtataataatttgagtaatttatgcagtggaatactctgcagccttaaagagaataagacatataagtaggaagaaaagttgggtggctcaagcggaattgcacagggggttttaactccattgacactatttgtatatgtatttatttatgatattttatttcttaagctcagtaatggggtacatggtgattataatattgctctttatacccttttatgggtgtctgaaatttttaaaataaatctagcacaaacaaaatgagacaactctgtatttattgaagttgaacagtcttcaagatgcatcattaaacaaaagccacagggtttgaatcgttgtcgatagtagtggattttcttgtctatgacccagttgaagaaatatattttacattctaacccagttcacaatgaatccataaataaagaacaaaaacaaaaatttcataagacgatatctacccttactatgaaacaacatgctctgacattttctcttctattcgattccatttcatatctatgtaatgttaattgtgatccagtaaattcattttataactaatagatcacaacctgaagtttgaaaatgatgatgtccactgtgctacactttatgtgtgatttttaatgaagctatatgcttgcatgcttacattatcatagaatttctctgaaaatattcacaataaatgaataattttgattgcatttgtggagaggaagtaagtggctgtgggacagggattggagggagatttttttttcctgcatgctcttttgtcccgtttgtactttgataatgtgctattaaattttttaatttaacataatttttcaaaataaaaggaaaatgatgtcatagattaatgaatccaattcacctgctttcttggccactttttaaaatagccaatacttgctgcttaaagggctccttccaatgttttaaattttaaatttaacataaatagaaatttaaaatttctttaacgtagctttgtatgtgtatattccttctgaaaataaagtgggaaacaaatctattatactgcaaataatattttgctctttacattactattatgtcacctgctcatattgattgtcctaatgaaattacagccccatgtatagaggggatatactttcttgtttgcttgaaagaactatgtttggagatcaagtttctgtcttacagaggaagcaaggcatggaagtattgttatctagtggacaagcagttttatgtttcaaaattgtttgccaaaattagcagctgtaaaacaagaacacagctgcaaatttcaaacttttcatattaatatataccatgctattttcctttgaaaccaaaaacatgtatttttcatttaacaatttcagcagtgtacacatcattgtgtttccctgaacaaatgactattatgctaaatggttgattttaaatagagtttccttattcaccaaagttgatacttttaacgttttgttttcaattggaaatttctgcttaaataattttcatttattttgatgtttgtaagtgaaaagttagtttgttggtaaaaaattgtcccgtattttcattgttccttcaaagtttatatttgctgaaataattcttctgaagttggagagattgtgtagcctgcacaaaaatgctgtgtaattgtttgatccattttaccatgcgaaaatttgtagccttgtgaaataatccaagaattttccttataccacatgttttataatcccaggttactagtgctaaacatggaccaaaacaaaattagtataaaactaaggtcatatcccattccatgaagaaattctgagttctctacactgttttcacctggcttacaggatatcatgctctctcagttttcttcttatctcagtggtcacttctctgtcttatttgctgattcttttccttccttctattttttttttttttttttttgagacagagtctcgctctgtcgccaggctggagtgcagtggcacgatctctgctcactgcaacctcggcctcctgggttcaagcgattctcctgcctcagcctccccagtagctgggattacaggcacacactaccacacccagctaatttttgtatttttagtagagacggggtttcaccatggtggccaggatggtctcgatttcctgacatcatgattcgcctgcctcagcctcccaaagtgctgggattacaggcctgactctctaaccttttaatttggtgtacaccagtgctcagcttttgtcttcaagtcttcaccatttatacccactcagtgacctcttatagtcctgaggcttaaaccatctaatacactaatgactctcaaatttatttctcagccaagacttctcttctgacatccattttcaattacttatttggtaatttcatttggatgtttaatagatatcttaaactcaacttgcccaaaactaaactcctgatctttccctcctacccaaaacttgcagacttcccatttcagttgacggaagctccatcctaccacttgctcaagtcaaaaaccttggagtcatcctgaaagctctcttccttgcaataccttacatccactgtattagcaaactctgttcactgtacctccagctccacagctaccacccttgtccaagccaccatcatctctcatctgggttaaatcatacagccttgtaacaggtctctatgcttctcagagtgatctttttaaaatattttcttattacaggttagcatccttttctttcagattggtatcatagaagtagaaagtggaatagtggttaccaaagaccaaacaggggaggaggaagggggaaaagggagaagatggtcagtgggtacaaagttacaattaaataggaaacataaattctggtgttctcttgcacagtagagggaccatagctggttaagaaaaatgtattgcatatttcaagataaatagaatagaggatcttgcaagatatcaccacaaaaaaaagataaagatttgagattatgaacatgccaactatcctgatttgatcattatataaaatatgcatgtattgaaacatcacactaccccataaacatgcaattataatgtgtcaattatttaaaaataataaaagagtagacaaaatatatgagtcgactctgctaaaaatattgcaaatggcttctcatttcactcagagtagaatatttacagtgatctaaaataccctccatgatctagctccttgttacctcacctccttctacattttttcttaactctgcagcattgttactgacatctttgtcaatctccaaaaaaaaaaaatacttgaggcacacttctgccttaggtacttcactgtggctgactcctctacttggaatcttcttcctccaagtattgcatgttttcactcttacacctccatcaagcttttgcttaaatgtctgcttctcagtgaggtctactttgacccattctacacactactgcagtttgcaccataatccctgaactcttaatacctttaccctgctctaccttgtctttatttccatagcatgtatgaacctctatataatttacttatatactatgcttattgtttattgtctgtttccatctacattaattgtaaattctgaggactaggatccttgtgtgttttgttcactgaagtccttaaaggccctagaatagtttctaggacttagcaggtgttcaacaagtacttttgaaagaatgaatatagaatgtaacttttggtatatgatttatgtctatgtctttacacagaactgaataactggttttgattgatatgaactattatttcttgcacaattagtatttttaatttttgtgggtacatagtaggtgtgtatatttagagggtacatgagattttttgatacaggcacgcaatgtgaaataagtccatcatggagaatggggtatccatcccctcaagcatttatcctttgagttacaaacactccaattacactcttaagctattttaacatgtagaattaagttattattgactatagtcaccctgttgtgctgtcgtatagtaggtctcatttgttctttctattttttgtatacattaaccacccccacctccccccacagccccctactacccttctcagcttctgataaccattcatctactctctgtgtctgcgagttcaattattttgatttttagatcctacaaacaagtgagaagttgcaatgcttgtctttctgtgactggcttatttcacttaacataatgatctccagttccatccatgttgtcgcaaatgactggatctcattcttttttatggctgaacagtactccatggtgtatattaccacattttatttattcattcaccagttgatagacgcttaggttgcttcaaaattttacctattgtaaacactgctgcaacaaacacaggcatgcagctatctcttctatataatgatttcctttattttgggtatactgctactatatactatacaatatatacccatcagtgggattgctggatcatatggtagctcaatttttaggtttttgaagaatctccaaactgttctccatagtggttgtgctattttacattctcacaaacagtgtgcaagtattcccttttctgcacattctcaccagcatttgttattgtctctcttttggataaaagccatttttgctagggtaaaatcatctttttttttttccttgaaacagggtctcgctctgtggcccaggctggagtgcagtggcatgatctcggctcactgcaacctccgcctcccaggttcaagcaattcttatgcctcagcttctagagtagttgggattacaggtgcacatcaccatgcctggctaatttttttttttttttttttttggtagagacggtatttcaccatgttggccaggctggtctcgagctcctgacgtcaagtgatccacctgcctcggcctcccaaagtgctgggattacaggcgtgagccaccacgcccagccgggtgagatcacatcttactatagttttaatttgcatttctctgatgattaatgatactgagccttttcatatgcctgcttgccatttgtatgtctgggtttgagaaatgtctattcaaatcttttgcccatgttttgataggattattaggttttttcttatagagttgtttgagcttcttatatattctggttattaatcctgtgggagattagtagtttgcagatattttctcctattctgtgggttgtctcttcactttgttgattgtatcttttaccgtacagaagctttttaacttgatgtgatcccattttcccatttttgctgtggttgcctgtgcttgtggagtattgcttaagaaattttttgcccagagtaatatcctggagagtttccccaatgttttcttgtagtagtttcgtaggctgaggtcttagatttaagtctttagttcattttgatttcatttttgtatatggcaagatataggggtctagtttcattcttctgcatatggatatccagttttcccagcaccatttattgacgtgcctgtcctttccccagtgtatgttactggcacccttgtcaaaaatgagtttactgtaggtgtgtggatttgtttctgggttctctattctgttccactgtctatctgtctgtttttatgccagtgccatgctgttttggttactatagctctgtagtataatttgaagtcaggtaatgttattcctccagttttgttctttttgcttagatagctttagctattctggctcttttatcgttccatataaattttaggattttttttctgtttctgtgaagaatgtcattgggattttaatagggattgcatcaaatctgtagattgctttggatagtatggtcattttaacaatattgtttcctccagtccatgaacatggaatatttttccattttttggtgtcctcttcaatttctttcatcagtgttttatagtttttcattatagagatctttcacttctttgattaattcctgggtattttattttctgtgtggctattgtaaatgggattactttgtgatttctatttaggaatgttcactgttggcatatagaagtgctactgattttttatgttgattttgtatcctgcaactttactgaatttgtttatcagttctgatagttttcttgtggagtctttatgtttttccaaataagattacatcatctgcaaacaatgataatttcacttcgtcctttccaatttaggtgtcctttatatcattctcttatatgattactctagctaggacttccaatactatgttgaataacagtggtaacagtggacatatttgtcacgttccaggtcttaaaggaaaggctttgagtttttccgcatttagtatgatgccagctgcaggtctgccaaatacgacttttataatgttgggatatctttcttctatccccagtgttctcagggtttttatcatgaagtggtgttgaattttatcaaatgctttttcagcatcaattgaaatgatcacatggtttttattcttcattctgtttgtatgatgtatcacattgattgatttgtgtatggtgagccatccttgcatctcagggataaatccctctggtcatgatgaatgatctttataatatactgttgaattcagtttgctattattttgttgaagatttttgcatcaatattcatcagaaatattggcctatagttttctttttttgatatgtctttatctggttttggtatcagggtaatattggacctatagaatgagtttggaggtattgtctcctcctgtattttttggaatagtttgagtaggattcatattagttcttctttaaatgtttggtagaattcagcagtgaaaccaccaggcttttcttttctgggagattttttattacagcatccattttgttattcattattggtctgtttaggttttggattttttcctagttcaatcttggtaggttatatgtatctaggaatttgtccatttcttctagatttttttgatttattagcatatagttgcagatattacactaatgatactttgattttctgcagcataagttgtaacgtgtcctttttcatttctgattttatttatttggatcgtctctctttttttctttgtctgtcaatcttgtttaacttaaaaaaacttttgtttcattaatcttttgtattgtttttcatttcagtttcattgaaattaaatgaaatgtatgctctgatctttattatttcttttcttctactgattttgggtttggcttgctcttgcttttctaattccttaaaatgcatggttagattgttaatttgaagtttctcctcttttttgatgtaggcattatagctataaacctccttcttagtactacttttgctgtgtcccataggttttggtatgttgtgtttccatcattatttgtttcaagaaatgttttaatttctttattaatttctccattgacccactggtcattcaggaacatattgtttaatttctatgtatttttatagtttccaaaattcctcttgttattaatttctagttttatcccattgtggtagagaagatgcttgatattatttcaactttttgaatgttttgaagacttgttttgtgaactaaaatatggcctatccttgagaatgatccatgtgctgaggaaaataatgtgtattctgcagctcttggatgaaatgttctgtaaatatctattacatccatgtggtctatagtgcagattaagtctgatgtttctttgttgattttctgtctggaagatctgtccaatgctgaaagtggggtgttgaagtctgcagctattattgtattggggcctatctctctctttagctccaacaatatctgttttatatatctgggtgctccagtgttggctgcatatatgtattcaaaattatgtcctcctgctgagttgacccctttatcattaaacagtgaccttcttttctcttcttatagtttttgtcttgaaatctattttgtctgatataagtatcgcaaatcctgctcttttttttggttttcattggcatgtaatatctttttccattcctttattttcagtctatgtgtgctttacaggtgaggtgtttttattgtaggcaacagatcaatatttttttcacccattcagccagtctgtgtcttttgattggagagtttagtccatttacattcagttattattgataagtaaggacttactcctgccattttgttatttgtcttttagttgttaagtggtcttctctttcttctttcctttctgtcttcttctagtgaagatgatattctctggtgatatgagttactatcttgcttttcattttttgtgtattcattgtatgtttttggtttgaggttactatgaggcttgcaaatactaccttataacccattattttaacctgataacaatcaacactatttgcataaacacacaagcaaaatgaaaaataataaaaactctacacattaatcttgttcctctgctttttaactttttgttgtttctatttatatcttattgtacttactatgtcttaaaaagttgttgtagttattctttttattggttcattatttagtctttctacttagaataagagtagtttacacaccacagttacagtgttacgatattttgtgtttttctgtatacttactattaccagtgagatttgtgccttcaggtcattattgctcattaatgtcctcttctttctgattgaagtactccctttagcatttcttgtagaacaggtctggtattgattaaatccctcaggttttgttagtctggggaagcctttgtttctccttcgtgcttgaaggatatttttactgaatatactattctatggtaaacttttttttcctttagcactttaaacatgtcatgccattctctcctgacctgtacaatttccactgaaaactctgctgccagacatattggagtttcattatatgttgtatgtttcttttctcttttctcttttaggatcctttttttcccttgacctttgagagttgtattattaataaatgccttgaaatagtcttctttgatttaaatctgcttggtgttctataatcttcttgtacttcattattgatatgtttctctaggtttgggaagttctctgttattattcctttgaataaactttctacccctttgtccttctctacctcctctttaaggccaataactcttagatttgcccctttaaggttattttctagatcctgtagtcatgctttattgttcttgtttttgttcttgttatttttgcctcctctgactatgtattttcaagaagactgtcttcaacctcaccagttctttctttgcttgatccgttctgctgttagattctgatacattcttcagtatttcagttgcatttttcagctccagaatttctgcttgactctattgaattattccaatctctttgttaaatttatctgatagatttctgaattccttctttttgttatcttgaatttctttgagtttcctcaacacagctattttggatcctctgtctgaaaggtcacagatctgtgtttctccaagattggtctctggtaccttatgtagttcatttggtgaggccgtgttttcctagatagtgttgatgctaatcaatattcttcgttgtctgggcattgaagagttaggtgtttattgtagtcttcactgtctgggtttatttgtagccaaccttcttgggaaggctttccagacatttaaaaagacttgtgtgttgtgatatatgctttagggggcattctaagcccagtaatactgtggttcttgcagactcgtagaggtaccactttgatggtcttggacaagatatgggagagttctctggattatcacgcagagattcttgttctgttcccttactttctctcaaagaaacagagtctatctctctgttctgaaccacataaagctgggaatggagtgacacaggcacctctgtggccaccaccactatgactgtgctgtttcagacctaatgccagcacaacactggttttacccaaggctggctttaaccattccctggctactgcctatgtttgctcaaggcctgggggctctacaattggctggtgtctaagccagccagctctgtgtccttcccttcaggtcagcaaggtccagaagtgttgtccaggagtcagggactagaggtaaaaaaaagcctttgaagaatacctggcgttctattgtattgtagctgagctggtactcagaacacgagagacagtccttcccactcttctttcccctttcaaaagacagaggaacctcgcctggtagttaccgccaccccaggccacagggagtactgccagactactgctgatgttcatttaaggcagagggtcttttaaatcagctttttgtgaatactgcctggcttggaactcaacctttagagcagtgggctcctctctggcccagggcaggtccagaaatgctgttcaatagtcaaatcctggaactggggaccccaagagcccgcttggtgttctagccccacttcaccatactggtatataaggtgcaagaaaatgtcccctttgcttttccctctgcttttctcaagcagaagttttgccccattgccaccacagctgatcatgtgctgagtctcacctgaaaccagcaagtctcagaggctcactcaaggcttttgatgggtatcattgctgtttatttggggtccaaaggctcttcaattagcaggtgatgactgttggcaggactgggtgctttccttgaaggcagcaggttcccttctggcccagggtttgtccagtaatgtcatctggaagctagggcctggaacaggggcctcatgactctgaccagagccctatcctgccttggctgagctggtatacaagatgcaagacaaaggcctcttcattattgcctctcctctcctcaagcagaaggaaggggtctcttttggagctgtgatctgtgcagcctggggttaggggagttttgctgccaacactcccttggctgccccagctggtgtctcaagtatgttacatgcccctcccagtccactgtctctaggcctacttcagcactaggactcaactaagagttgcagtccttatggcctagattgtcattcaggtttacttggaggcacagaatgctgtagccctcagtggtgaggtttgtacccactcaagtttggacctctgagatcagtgattccctccctggctagggctggtttaaatgctccctctatgggtggttgtctgctgagtttggtccggttatcctttttgctctaacaaacagttcagcactgagttcagtgtctcataattgctgtgttctccctcccccagcgcccagagatactctctacaccacacagctgctgccacgggcaatggggggaggggggtattggtaattcaggactgttttttctatctcttcagtgccgctttcagcaatatgaagttaaaaccaggtactatgagtgctcacctgatttttggttcttatggtgttttttctacatagatagctgttaagttggtgccttttgcggggcaatgggtggaactttctattctgcttcctccacatcctccccctatttcttgcacaattgatttttaaaggctttgtttatatgtgtaagccagtttggtttctgaaagacttggtcaatcagctcgatgaagtcagtagtttttaaactcttaatagttgaatcagtgaaacctattttctggtttcctggatttgttccgtttcagtttatgatgactatactggcccttatggtaatatattcaagctaacttgtgcatggagaaatagttgcaattgatatgccaaatcaatgcatgtagacacaaccacattcaatcacaattagtcaaatgagtgttgtagaagaactttatactcagcatagttcattttaagacaaggaaatagcaaataccaattgattgaatgtccataaataaataaataaataagcacatgcatgtattgttttgagtgatttatgaaaataagcaagttgatcaaaattgtcaaataggtcgattcatataagacattgcctaaattaatatgtcatctgactaaattccctagtaattccagtaaaaactattgaaattttagtttatgaagatataatcatattttatccaataatgcatcaattgattttttagaaagcattccaattagaatgatcaatcaatcccatcaaagtttttaataaatgtggatctatagggtagtcacacctaaagtaagactagaataagaaagaataaggtgttaaagtgagattttactaatcctgaatcatgtcggagtttgaggaaatatctgtagaggttgaaaagtgtggcaaatggaagttcagcacttcagccttaaaagaatcataaacccataaactcatgacatttttaccagtcctcccatatttatttgcagtcaaaacaatgccacagctgacatttaggtaccccaggaagcaaaaacaaaacataacagaacaaaacaaaaacaaccaaaaaacagaaagataaggaaggtagacagacaatgctagctccatggattaagtacttgatatatatttttactcgccctcaatacataaattattttaacctttagttgcttttgttttatttctggatgttataggatactgtttgctcatttgtataacttgcatagggagaagtaaggatttgggaagtaattttatcttgtgcctcagtgtagttttgtccctaagctctgtcatttgtatatcaaactaatactgtcatttttatcagcttcagccacaagaaggtttatcaagatgtttctgttttacttctcgtttctaagcagctgcctagaactagagtcacgagtctgctaaattgggcaggcattcagaatttttttttatcacgttctcccaagaatcataattttataaaaagaaattagcccaaggtaaatctcaggagaaaagtggttttctctaataacttgcctccaacgaagcggttggtctttacccacaagaactagaaataataatttttttgtactttataccttgggtctgggagatttaaagaaatatcttgctttccaacaacttgggtttcagttgttccagattgaattagtgtaaataacataggaagaaggaccctagcaaatcaatactgcattggtagtaaactggaaaatactgacaaattatccttttagtccttagcgaggtttaatctaaacatcgttttctcctgacagcatgagagagaagagagtaatttattacaccatcctgatatggatgagaaaagactgctgcatgttcttcagtgttctggctctctccttctttatgccagttcaatttttgttttgctccagaaaagcactctccaataatatggttacaggtcttgtaactttaatgccgtagcactactctcttccattgtacatttgagaacttgccagctggtataagaatgtgggttaagtgctcagttgagattcagctgtctctcattacatacatggggtatgttcctaaagtcctgtacgcaaataattttatagctttacctaatgtgtgaggtcactatgtagaggagtcttttagaaaatcttgtcacattataatgtgaataattaccctgcccctaaatttcacgattttcataactcgagatttttgcttgttgggtttatttaaggtggactctctctcttattcagttaaagcttacttcatttataggaaagggggaatttgtgtttactgaaggaaaaatatttagcattatttctttcctaatttcctgtggtttttgtttcatcaaacaactcttattccatgtgataggtgtgtaatacaaatatgtgaaatatgactcacaaatattaggtcagcaatttgttcatctttttctgttaaataaattggtcatgttaaatgtcacattttccaacttggatatgataaaatagcacttttaattaacccaagagggatatggacataagaaaaccataaacacttgctccaggcaggatcctttctcaaggaactgcattatgaatatgacttaaattactggttatatgtatcccgtgtattttgcaaaacctaaaatgttattatattgtcattacacttccacagttatcatcaggataataaagaaataaactcaaactttctttttgttttttttttttttttgagacagggtctcaccctgtcacccaggctggagtgcagtggcactatcttggctcaccgcaacctctgccacccaggttcaagtgattctcctacctcagcctcctgagtagctgggattacaggcgcctgccaccgtgcctggctaatttttgtagtttttagtagagatggggtttcaccatcttggccaggctggtcttgaactcctgacctcatgatccacctgcctcggcctcccaaagtgctgggattacaggcttgagccaccgcgcctggccaacctcaaacatttttaacacattttgagaatagtgtacatactaaatagcaataaatgtttccctacatactcttccccatatcaaatccaagccttaaaatgtttaattgctcatctagactccaaaaatatttaaattaccaggtacctctagccaaaggataaaaacattaaattggaaatgattaacatatttacaaaaaagaggaatttttctaagaaattcggttaaacttagttccactgactcagaagaggaaggaatttcttctggaaaacattttctaaaatagcaaaattcatcataaatatatgattgggactattaaatataaatgttgcagtcttaatcatctatagaacaagccattatgacaagatttccctgtataaatgtgcagcatgtttcatatgccagtgtgttaaaaaaaaaaagaatcatttgatgacttaaaaataactaactgaaatatttgaatttgctttgcttcagatatcgtatgaaatatcattaccattttgtgagaccttttaggttattaaacatttaaaaattccttctgtgaacaaggcacttttataggagagagacagtgggaagataaggggaatgtaaggattacagatgtgctcacagcttagcagcttgcttacttggacttaatgatactgataagagtaattctgatgacattattaacctatctctatataactcagccaattgaccagaataagatcaatattttttcccagttgtcaagacagccaatcaccatggctttgattggatcatggcatggtcaatccaattcattaggtaagattactgaaataaaccacactgagagaaaccaaatgccagttaggtagtgagcaagtgccaagtggtggaagagttctataagagcaagctcatcagatgatttcttcaagtcgttattcatgtccagaattgattcagtgagtaaagtcatttgaagggtctggaagatataaagtcgaaaaaaatgctttctaaaatttaaagtgaaaacatctgttagcatgtattagaatttgtttcaaaactacaattttttattgtacaaacatttgtcaaaggactaagaatccagaaataaataattagacattttccttgaccttgagaagttcataatcagtgggcagagtaagggagtagacatataaatagataattatagtgcaatgtagtaagccttgtaataggtgtatgtaaaatgcatgcattagaagcacaaagaaaataagctggagaaatctaggaggatttcacagagaatgtaatatttgaattttatcttgaagtatggatatgaatattttgtctttttctttattttcttctatatttgtgcatgtgtatacacacatgcacatgcattagtatgtatatcagttactaccctttcatttgtgagtgactaggaaaaggtaaatatttgattgcttctggttttgggttttttttttaacagctttattgagatagatttcacacatcatacaattcactcatttaaaatgtaaaattaaatggtttttattatatttacagagtggtgcaactatcaccacaatcaattttagaacatcttcatcacctcacaaaaaccctttacactcagctgtcatcttcctactcctttatcccccaactgtaagtagcactaatctacattttgtctctacagattttcctattctggagatgtcatacaaattaaatcatataatatttgtcaatttgtgtctggcttttatcgctttgcatgttttcaaaatttgtctatgtcataacacatcagttaaattccttttaattgccagataatggctcattgcgtggagatatcacatttgtttgttcattcaccagttgatggacatttggattgtttccacttttgcccttctgatttcacagagagtgttctatttgttttcttttaattttctaatgttccatcttgtcaatttttttatcatcttggataaaaattatttttccccgctgataattatatgttctactgagaatatgataaatgtggttttccctcagatgaaaataatctgatcatatctgtggtcctaagaaaaatttttctctactatctgtgagatgtagaggcagctcataagacagtgacttccgaccttttatggccagggctcataagaaatacatttttcatcacaacccagtacatacataatttatgtgtatgtattaaacaaaagtttcacaaaacagtgtttatgcttactatatgcagtgcactgtgatagcctatcctattctagtctatcctaaccttttctgttctattctaccctatccaatctaccctgtcatattatagtctattgttttaaatgtacattacatgacccatacattgatttcacaacccactaccacgtcactatctgaaattttgtaaacttcagatttcaaatctgaagttctgttataggagagagaccagaacacattctgtgtccagaaatattcatctcatctttctgaggcaatgactaaagaatggtattttattttattggttgatacccatcaaatgttggtgaataataaaaagcccctatgttgacacctccattcttaacctactgacctttagaagcaaaagaataattactggtatagttcattaccttcagaacagtaagagtaactgtgctatgaatattattcccttctcttgggaattaactttcctattatgactcataacatttcttttgtactaggaatgtaaaatgtaccacttaaatataaggcattataaggaatttagggcattttaatataatgtttaagttttttgatctaatgttttcatctaatagtttaaggtcttttaatctaatgtatataacttaaatggacctttccctctgtattttaaaggatgccttaaggtgacatgatttctctagaatgacaagtcccaaggaagtataagcaaaatattcccatggagagtgatagaataacatgaaagacagttcagactcatttctcatatgactcacttctctaaatttggctttaacagcttatattctagaaggaaggaaaattggcagtcggaattgaaatgccagtgaataaaatgtgtctataggacacaatatgataatattacatgtgttggtgacctattaaaaaaaaacaaactgaaactcccaccaccgtacccaacactccttcataactcctaaatagaagggtactcttattctcttcctatggtgacttcattgctgactttcttcctttttctcttcccacacttctccacaaacacatacaagttgggaaaactcctccaaagtatcttcctaccttctatacacaaatcttcctttcctcttttctttatttttccacttccacaatcttcctgtctcttttgtacttgtggctgtcatttccagaagaatccaagatgtacaattgacaggaaacaccaaactgaattatagagacgggcagaaacttcaactttgcttctttcctctttacctgttaccctgcactttcagagaacttaattgtagattgcaaaatgaagatcaagcaataaccacacacaatgaaggattcaaggaaccctaaaaaggaagaaagtgaaagtagtagaacctttcttgttacacatctctattttatttattcaaatgctattcttttttaagtctatgtttccagcctggttaatcataaaagctcaatcaagcacttcattttggtcttttttgtgtgggattattaatgccgtgggtggagaatttcacacaaagtagtacacttaagtcatgcccaataatggctcagaaaattggttttgtgtatatactttgtaaatagataattcccaaatcaggtaagaaaagagaaaagacagaaaaattataaataaaagtgtagaatatacttctatagtgaaggcttatccttatttcaattaagaattatgacttatgaaagtaaatacataaaagcttagatccctgttgtcaaatgcgaaacatatgaaagtatcacagacctatgaaatgccaaatacacttgcacttattcacgggcactaataactttaattaagccagaacatctcaaaataacaataatgaaaattatataggtaataagactataaactggacttgaataaatgattttgttttctttagaggatgttggctaccattcagtctccaagtataaaatatttattacatgtccatttgcgaaaaagataatttttaatccaattcaattttacatttttctattatcctaccaggcagagtttaatgcagtacagttgaactcatgtttattgaataagtttttcctacttgcctggagtaagtgcatttttctattttgaaaatctttacttaaacttaaatgttttccactatttttccaaacaacagtttagagtattgtgtttacttgaagttatgtcttaagattttgaaatttctttcccagatagtatttatgaaatatattttctgttgtcctgttgcagtaaactttttataattggtattttaatgtttcttaagccaaaagaatgatactatatgtgctagacttatactcatccttatttttggtttggactgataaatctacttttctgttaggaaaaatatctgtctgaaataatctgcctccattttctttctttttaatttcagtagttttgagggaacacgtggtgtttggttacatggataagttcttcagcggtgatttctgagattttggtgcacctgtcacctgagcagtgtaccctgtacccaatgtcttttatccttcacccacctcctaccctttcccctgagtccccaaagtccattatatcattcttatgcctttcaatcctcatagcttagctcccacctataagtgagaacatactatatttggttttccattcctgagttacttcacttagaataatggtctccaactccatccaagttgttgcaaataccattatttctttccattttatctgcctctattttctgacaggcagctcatctgaaaccctaacttcatagtttcttgacctctctctggccaataatcattgccttcactccatttccacaattcatttcctcttctccccctccttcactctcactgaatcacttctggtctcatcaaggccctcatacctccctagctacctatctatttcgtaaaccttttcaggctctctctcttaccctatttcaaccgtgaactcattgacactcttgtagttgcaccatcttgccaatcctcaaccattaatcagctttccttgatgttttctttcatttttccttcttcttctttctttcattatactgcttctgccaaagaaaatcacatacctgattgactggtgccagtgcaaattcataatatccaacttcagccaagcccttaaaactgcccagctgtctcgatttttgttcttaagtcagttcccattctagttccccattcttactgcactaatgatattgtctctgaaatatttactccacgcacaccttcgcagacagcagaaaatgttgctttctacctcatagaaaaataaaggccatcaatcatgaagtcccctctattccctgccaccctacactaaatatacctctatttatacttagtcttaccacatgtttcacagtaagaaatgtcctttccccttttcattgtcaactctcattctgtgtttttgatcccatacactccccacctcctctggagcttacactttcaatgccttctcgcttgcattattaatctctctattccctcataaatacttcctcatttaccatttagtcctcagttttcatgggttgctactaatttttttccggccctttgcccaaatatgacgtactctgtgaggccttccatgatcacattatttaaaatcacagcttcagatactgtatccacacaattacttccttttctcttttcttgctttaactttctctttagcccttgtcaatatctaacatgctttgacttatttttcttattaattatctgccttctccaatagaatataaactccatagggcaaggattttgcctgaattcttatcaactaaaacgaagtttgacacatagcaggaacaaaatgagtatttgttgaataaattaaatgtaatttgacttctatttccaccaggctattacagtcctaaagatcatcgttgagattatggctaaatccagtcctcattttaggtctcatcctacttttagtagaagtttgtgtaattgtacaattgttcccttaagaaaaatgatttatctgggctatccagtctttttagactccttcactgatgttttctcttcattccacccttgaaaggtatcagtgttcaccagatatctgtcctcggaccttttcttccttgcactctttttctgagaagtatcatccgtatctatgttttttaaacactgccagtggcttcccagtctagatttctagtccctacttttttccagaacgtttctaactgcatattggatatctactagatggcttgtatgtttttcaaactcaacacaaccagcattaattcagtaccctctcttcttcctgaatgccttgttttagttaatggcatcaacatctactcagtctctcaagatatatacatttttttatttattctaggcttcttcttctcccctgcctccaattctgttccaaattctaataactctacttcctaattccatttctaacatattcctttttctccatcttcttcacctctgccttacctccagccctcataatttttcacatgtgatataataatagttacctgattttttttctaccttcagtcctgcccaaatccaatcaagcttttatactgtcaccataaataccttagccaatgcaaatctttccatacttgtcccctcttgaaactcaacgactatcctttgtactctcagataaactttttactccataaagcctagcttcaacctacctttccaacatcttaaaactctacaggtaactttattcatttttctccaactacaccacacactttctcaactccagaccgacagcttcttttacccagaatgtcaatttctttcctttgtatctggcaaacttctaagcactattcaatagccagttcagatagcagctcctctgtagatctctaaatctcacaaggtaagtcaccttggttttttaccttagagcattctgtatcgtttatctctatgaaaaaaacatatttacattgtgtttcaaaaactttgttggcatgtttatcttttcactgaactgtgagctcccagccctcaagtaattaagatagtctagctaaggagatagcacacttacttaaaagagtaaatagtgcaaggtatgatatgatgatcatatgatagaaatggactgtgaatggagaaatggaagcaatcaggattacttcatggggttggatcatcagggaaggctgcacagaggaagcagctctcaaggttaaatggtttttggataagtcaagaagcaaggacccagtatttcacttgaggattatgctctgagccaatatgaaaagatagctcaagtagaatagtgagatggacattgggacagggagatttgagcttgattgtggatttcctaaatgtcataagtttgctattgtgttgtgtatttatatgcatatgcacatacatgccccttagatacttttcttttctacccattcttatcctaaaattaccaagtctaaactgaaagttttctaattcctcaagaataatctgatttatactcttgtattatcctatatcattcaaaggacttctcctggagccctgtaaataaggactgagataagggatgtaaatgcatagggcagtgcccaacatacagagagtgatttataaaggtcaagattttcctcttgacctcagtctctgatctcaggggccaaattagatattgtactgattcagacaggaaaacagaaaagaagagagaaagtcatagatgggataaaactttgatcacagagatcgttttgttgatgtgtcaacaatttttggctgataaagtgaagaggcaataaaaacagcagtgcatatgattctgcagtttgaacagcaaattgcagcaaattgtagctatagcattggaagttcttcttgctctctggctgtctctttattcagaagtttaagttaattaaacttggctctcatagtgtttgaatgccaattctaaatgcctgtggttagaaaaatcacactctataaaatcggtcaaaatgcatattctagaagagtcatcacaattgatagtgatatttcctaacatccattcatcctagtattcttgtttttttttcttctattgtgttttttctaattattatccgctgagattagtggtttgccctttgctttctggcatggcacattgtacaaatgctttgtggtaggactttaatttgttcatcatgacaccgtttctgcctttgcccatgggaaaaataaaatcgagtcattcctcctctggccttcttcagcacatatcctgtcagtatgatgtttatctcaacctgcctattgatgattacattgatagtgccatatcctagtgtgcggctctgtgctcctggctttttagttttgtagagtttacttccttaatagaaagcctgtatgaacttaaaaagtcaccaatcttctcatattaaggaacagaactacctataacatgggtttccagccactaccttattcaggtataaatcaaaaaggaaattatgtgaatggcagaatatataaagctgtgtgataatgagccacattgtagtgaggctctagcataataactctgaactgggtttttattttaagtcactgaaaatgagggctggaaaatgtaacagatttgggggaaaagaggtagaattagatctactatatttttgaagtattttctgaaagggaagtgggatttaaaatattggattgtttctttttcagtcttttttatcccattaaacacaggctttgggtataaatcctggtatagctgactaccagccttgccaccttgggcaaattttgtaccctcttaaagccacaatatcctaatctatggccacttcacaggagtagtgtgaggataagttgtgtgagtaagaactgtaaatgtataggatgatgcctaacatatagaaagtgatttatagagttcaggtgtctgcatttggtggtagtttagtatcagaaagtagtaaacaaaatagctgattgagtgctttctcttatcttccactggttagtatgacatcagacagaatattagaacaaggtacttgtattagtttttcactgccgtgtaaaaaattatcacaaacttaaggacttaaaacagcaatttattatctcacagttgctatgaatcagaagtctggacacatctactgggtcctctgctcagggtctcactggactgaaatcatgatgccagctgggactgaggtctcatctgatgatgctcttcttggcagaattcagttcccttgattataggactgaagtttctattttcttgttggctgtcagccaggggtcactctcaactactagagactgttctccagtttttgtcacgtggccctttccataggtctactcacagcatggcagctttgtctaagccagcaacagagagagagagagagagaaaaaaagaaagagagaggcagaattttactacatactagtaaaatgagtcctatatgtatatggtaatataattgtgagagtgatatcccaccacctttgctgtattctattgattataatgaagttacaggttgtactcaaactaaaagggaggggattataaaatggcataaatatggtggccatcttagggtctttgtgccacaatactcaaagaaataatagacaattcactggcctaagtcttaagagaaataatgggtagtatcccttgataatagtttaacatgcctaattcaacatgcaaatacctcatgtttctttttcctgaatctatgactcttgaaactaatattttggagattattgaaggataattttactttaaaaatattaattacgtaagtaacacatgattatattctttttgtaaaacaagaaaaattaaaccatacaacaatataaaatgaaaaagtaatttattctgcacctcctccttacctttaccccttcccctatccagaggtgctcaaggatgatagtttgatacttattcttctgtaatatttttaaaacataaatgagatcatgttatatgtgcgttctgtaacttgctttattcttttttaaacaatgtttcttgaatatctatgacagtatagatagatctgcctctgttgcttgatttttttttactatgtgtgagcaattaggagatttcccattttttacttttatgagcaacactacaatgaattctatgtatgtacatatttatgtacctgtgggaattatcctgcagtaatagattccctagaaatggaattgatgggtcaaagggtatacacatttaatttttgacaggaaaacaatggaagctatctgatatttaaatactggtaaaatgtcctccaaaaagaccagatacatttacaatcctagcaacagtgtttattcaagagtctcatttttgtccacattaaggtcttttccaaaatcagcaatgtgttactcttaggaacgtgataggaggtgcaatagaggtcgttgcagatggggatgagtaggagtgaaagatccctggaaactattgacaggggcagtatccatttggctgaccacagaaaatttagatacactaaaaaatttggaaactacttccaaggctgtatgatatcaagagatgtataaattagagtagtcattcagatttagcccacattatgcacacatacctgcatgtgtggggagggaggaagaaagagagaatgagaatagctcatttagagagtgaacattttagaagtataaaaatatagcagggaatgttgataatgcgtgttattaactcaacagctctaagagtccttcttcaaagccatttccaaagcacctgtgattacatgattagagaccccttaaaacaagtaaaataggtctgtaaactaggttatctatcagattactaaaaagcccgctgatagctgtcataaaataagtcaccattcatacccctgccaaagaaatacaattgtcttgataatatataataatgccaaaggatattttgtagaatgccactgctggagctgcatggagattcttcaatttgctgattacaaagcctactcagaatcttaaggctcaatcctaaccattgtgatttgtggagacttgcatttcttgtccagtcttctgaaagtaattacaaatgctgcagaaatactcagttttatccaatttctgacagatatattctgagtactcccatttatttattctcttttgaatgagaatacatgagaggaagacaacaagaagatagaccttactccatgctttctgttttgcacacacacacacacattcaattaattatgtctacaatttatggatcgatcatgtaaagtggtaatcttggcttagaccaattggtttaatcaccctgaattgcatgtccaatacagaagttacagacacactacactgccactgctgaaagttgctgattatagaacatcagtagtgttttgaaagattcgaaggtattttgtacacaagcaatttttaaagggaatgattaaacaagatttatattatttcttacgtttagaagtaaattattatttcaaatatgttataatttcccaaaatatgttatagtgaagccctagttttgtactagactccaaagcaaaatagcccatatattcaggaagtgctgattaccacagcccactcttggtgactgagagtacatactagcatatttaaaggctctgagaagtcctttaataaagaaacctgtacagatatgttcaacacaaagttctccaaatttatttgtattgagaactcttttctcttaaaactctcactgacatttccacacataaagaaatgtaaatttaagagatatcattcctagcattagcattacttagctgtaaaatacttatttcagtgtttaccgtgctaatgttatatcgttccttttaattaatttgatgaaaattttaattcctcttaaaaatacacatgtatctcaaaaatattgaaagaatacacttggctggcaaactgatggcagctttatttataaaactcatcattaaaaacttattaagattgtggaattagtcatgcagtggggaagaagataattctggataaccagatctcttttttcaaaagattatttgaatcatgtttaatgaaaaaaaatgcagccctcagaagatggcatttgataaagcttcatctttgaattaatttatttttcctgttatcattgttaattttgcttgtgaaagataatctaaggacatctcaggaattagataaagaaggactgctgggtcaccttcatccaggtgatgaactgataactgtgattgaaaattgtagtcaacttaaaacaaaacaaaataaaaaaggaaattactgtcaaatggaagtgtagttttggaagctgaacccttataaattgtattgatggggaacctgcacctgagccacggtgaatcacttcacttggattatatttaatggcaattggaaatatccttgttccttatccttttattatatggcagtttttttgcggttcagctcagaaagtcaagtttattgggaaataaattttcagtgtttcatatgttgtctttaaagaaacagtggtcaccacctgctgcttgacacccaccgatgtcgtttttcttcccaatcaaagaaaagcaggtcagcaatttcctagcaggacaaaagtactaaaggttacttttttccctgcgttgtatcatgggcaaggcttatacctagcatgatgtggggcatatctcttcctaacctccttccaactaccccactccccctaagaagaaatatttgtactactgccacgaagcctgaaattccatagtagcctcccctctggatctgaataaattaaatatattctctatgaaggctacaatttggccaggtgcatattcacgcaaagcttttattacttctaagcctttgtataacctgttcctggtgcctggaacattgtactctcctctcttctccctgacccccaccctatccactcacccataaccctcccagcctgccagacttttctctaggatatctaccctacccgcttccgtacatgccccatcacaccctgtaatttccctaccttatcttaaaaagtgggagggaggtaagtcctggtgtattttccttgctttgctctaaggtcctatatatattttgtaatccttaatcactcagggcattcaaggcaatgtacgtctctctaggttacttgtgttagagaaagacaaaaccaagggacttatctgatgctcggaatacaggaccttaatgcagctttttgtttgcagaaaataatgttactacacattacatattgcagagtttctgcaaatttacacaacctaaaagcccaaagagtccccttacatgctacatgatcttgttactcaaaggatggtccacagactagcagcatctgtatcatctgagaccttgttagaaatacaaaatctagggcccactgaagacttactgaatcaaagtcgggattttaacaagagtcccaggtgatttgtgtgcacattaaaatttgagaagcagcagtctagaaaaaatgctggcactgtgctggatatgtgtcttagttaaaagtgtgaaagactgaaagggaattaccttttatttatttggcatagcattacttttttagaacctcaagtccaaaattaatctaagtgttttgaaaattagagaatatgtaatttttaaattttagaataattaaatgtgtttcttttgtttttaccccatctcctccaaggatgcagtgattctccagtaataatggccctactagtcacctggggtgcttcttatacatacaaatctctaggccacagccccagaaattgtatattacatggcctgtgataggtctatgaatctgtagttttaacaagcttcacaagtgattctgatgtaggtggtccatggacctcattttgagaaacagtagggggtcaggagtgacagggagacagaatgaaatgtaaatatattaaaataaataccatctgcatcaacttaactgaaggtacgtccctaaaaatacaacaccagttgacagtctttttcagggaaccaggtgaatagcatattttaccttcagtgcaacttttattcatgtttgccgagtttccacaatcagtgacatattatttctcaacatgaaatattagttctgtggaagggcctgtggttaaaagccttacctatcattagctatcaatgtacataatcttctactggaagcactcaaaacatagcacaaaaatatgatcaccccttcccctccaccatgattaccacccccgtcaaccacacagtccatcaagaccaagagactactgctgggagcaccaaaggcagtgttacggaaggggaacttcctcttagggatcaaatgtagctctctagactgtagcccatgcatttataagaacttgagaatgacttgggtctattatgtgtctatttgcctggcaatagattctggaattgattaattaaatacattggaaatgataaactggaatacaaggtaacaatagtttgtgtgctataaataggaaaacacttatttttatgcccttgaaaattgctttctacttggctaaaaaagatctagtgccatcaactctagagaaagcactaaaggagtggctttgcctgtatctaactaacgattccacacagcactgaagtagaaaaagatgagtctcttacataaagtgtgcatctagagaggagggtgagaggagccactcatgcataatgtggctcccctgtgaacaaaacaaggaagccgagaagtagatgaagttcttgatttcaccctggctgttaatgataatgaatcattgaatgcatctgttccttgcattcctacggcatagaaggaggaaaggaacataaaatataaaacctcaacgcagttaaactacacaaaatgaagaaaacactaaagaaagtaggcccctcagttaatggaactacaagcaccaaatgatactctttaagaggtagtgaagcccagctgaaatctgcatcaggaattctgtggggttatgaagaagaacacaaacaagtttggacccctcctttaaaacaacagcaattttcctgggaaagaaaaggtgctaaaactctgcatttcctcccaatggactgttgcagtattttatgaaatacgtgaagaataaatgtattaattctactcataaatgaacaactccatgcattgttcaaactggctaaagaaccactaaggaggattcctgaggtgaggaacagatctcttaaatgagtgatctggtgaaaggagtagggagggggggaggcaacgggaatcagctgtagttaatatacttctaggctctgaatagagtggcaagcagcacattctgtaaactctcaagtactgaagctattgcaaatagcagtaacaacaagtggctctagatgagcagaatgcttggcaaagctgctcaggaggttaatgaagttgacatgggtttgaaaaagtggaaaataatgcatcttgaatgacaggatctcattttgaaagaaacagtgcttaaagagaacaagtttaattttttattacaggtgcactgttgattatctaattcaaacatgggtgatgtgccaataaaaatacccagtacatgatcgctttttacagcttgcattcaagctcggacaaggcaaaaatgatactctgaatgacagcagaaagtacatttaaggcgttcatcactgcgggtttgttcatgcttgatgaaaggacctgagatttgagagaagaggtaggatgatgtaggaaatcgcatcatttgatctaagggaccatgaatggaatgactaacggtataatgtcaaggacttctgtacagttcaatgcagaggaatatagtccccttgtactctgacctttgggctagaaatccttggtaattagcttaaaaatgaaaccagtatgctatggactaaattatgtccctcccaaaactcatatgttgaagtcctaacccttcatgtgatggtatttggagatggggtgtttgggaagtcattaggtttagatgaggtcatgatggtatggccctcatgatggaattcgtatccctataaaaagggacaccagagagcttgctccctccctctccaccctgtgaatacgcagtaaaaaggtggctatctgcatgccagaagagaccccacacaaaaaacttgatcatgttggtaccctgatgtcagacttccagcctcaaaaacggtgagaaagtaaatgtctgttatttaagccacccagtctgtggtgttttcttgtggcatcctaagctaaggcccagtggaattgtcattcaacttccagcttggtttccttttcataaatagagcatcagcaaaggaacctgctgcttgtgagtaaaggtgggtgacatgcgcatattgactttgattgtttcaagcacaggaattcatctgatttctcctgtcatttagcagagccctgaggaattctgtcagtcttcaggggtttttcatttgttcatttactcatttcagaaatatttattgagcatatactttgtatcagaaggtacactaggtattgggccatggtaatatggagttctaggcagtagactgagagcacagaaatcccaaggggtgatgaggaagaaataccagaagagacatagaaaactaagggaaaatgaagggaaagacttgtcatgattttgcctatacccagtcctggtaacactataagtatgagattaaatgctgcaaactttggaatatttctagggaatcaattcgactttctagaggccaaccattcaattacaaacataacttgctattgaaaaaccacaaaaaaagccaacctacggtgattatgcatgagagacaaagttactcaacatgttcttaatgtgtcctgtagtcttcgtttagagatcttccagaattcgtataatccccaggaggggcctctatttctgttaagatgatgctggcatcacatgccttcctgtttagtaagtggacagtggtttgagagcatctgaggtgataaagacatagtgaacattgaccacaggtaaaaggaccagtaggtggtatgctgattccatgtctatcaaattatctccaagtccattccttttttttttttttttttaatcattcacagaaagaggcagccacaacactcacctgctagccaagatgggtcacaaactaagctgtgcatgcagagcttttgagaaaccccaggttaccaggaatagtacagaagcaattgtgcatgattggtactcctctgcgccttgttttgtccactttttcctaataacagggaacacatgttgcatgccgaggaaatctttttgcctttgcaggagtccttgctttcatttacagaatccaagctccctaagtattgtagctgggtttaggtttagtttaaattctattgctgatccatttgctccctgttttgcctttctttaaccaaaaggacaaaagatgatgtgtttatctaagtgtgtgtgttttccactgaaggagaaaggcatgggggagaaaacactttttccacccaactgaaggtaatgtttagagagtactgttttctgactatttttgttgcctgttgttttagtaaaaagtatcgagttacatgacaaggttttactcttctgagccctcaagtacaaactttctgaaggtaattttaggcatagaaatatcttttccatggcaactatgtgcctattttgatcaacagaaaagtgtaaatcaccttgaaataagcacagcaaatcatgttctaacttcattcctgttctgctagagaaattgaactgaaatgtaaaagtaaaatggcatattaactttgctgtaacatattaatgtctaagtaaaattataatgtatattataaaatgatatatttatatatgtgggtatttttaagcttttctttggcaaactttcattagtaatgagcacctagagcttcacctaaggtggccaactaggcagttgagtactgattagcacatattttaagcaggatctgattaacctaacgaaaacagatcagcagctttttggaacataaggcatttcagagatgttgtgctatgtacatttgcagattcatgtagcttctaaactatgcataagcagcctcctctctttatttttttgtgcatttatctgtaaatgtgctctcaaggggttagtcttgagctgtttctaaaattaaccatctaacacaatatgtacccataatttgtactcagatacctgagcagtcattctcaaagtgaaataaatgattgaatttttcccaatgtttctgccatgtttattactaagtctcattgcaaattgaatagctaatgctccaagctaggtgatgatcaatcttaaaatataatcaatactttaaaattatattatgctttcagaattttcattatgaagcagatcagtcttgagcctctcccaagagactttagttgatgggtgtatcaaaagaacttatataagtggtttttgcccataagagaatctcatgttataagttccaatgacatcattattataagcttattgtgtagcaccttgaatttatctaatggtgggcatctaagaaaagaagtatattttaaaagtagtgttaggttaatcagatcctgcttaaaatacgtgcaaataatatttggtggtcaatattattatcgtcatttgaaagacgaaagaacagaggtccagagaagtcaagccacatgtccaacttataagaagtcattgccggaggttgaattctcaaggatccaatcctgtgccctatccactcctgtcactcagctgtgaagccatcaaggatttactataagcaaaactaaaagcagcaggatctccttcatttgtgatgtaccaaagagataaggtccaatcacttaacaaaatgaactgaagctgattgcatctgaaggacagggaccagacgatttaaaataacttttttttggttcatgcctaaatgaccattgatgtacttcacttagaaaaaaatactgtaaagataatgcttcgttaatttccctcatcttaatatagtaacttttatgactagctaataaacattttcatcagaagaacagagctaatgatgacacttctgtttaatcagggacttttcatcacccttttgtacactgagtattccattttctttccctagtcttttctaaacacacacacgcacacatacactttttctgtatgaaacattttaaacatacaagaacagtgcagaaaatatggcatttatgtgcacacaaccaatattaaactcatattaacatttggccacatttgcttcatagcactctttcttttcaaaggtagaaaatttaaaagacctaggtaaaacttcacttccttctttccttcccagagttaactgctctcctaaagtcgatatagtttgtatcattccttgcatgtatagtataatgttactatatatgtaagtacccataactataaattactaaaactctttttactcctaaaatttgcataaatattttacatgttttacaaatagattttttcaaacagctttgtttttgagatttttttcaggtcgataaaggcagatctagataatttgttcctgtgtaatattccattgtatgaataaaccgcagattatctatttcctctgctgagagacattcaaattatcttttttttaaccacacaaacagggcttcaatgaacttccttatgcctatttcctgataaacacaaatgggagtttctttgggatagatacctggaagtggaattcggtttttatcttcaaatacattagatattccagatggccttccaaagtaattgtattcatttccgtatatccatatatatgtgtgtgtatatatgcatatacatatatgtatatgtgtgtatatatgtgtgtttatgtgtatgtgtatatatagagagagagggagagacagagagagaacacttttttcccatatcatcaccaacacgtcacttggtgttaacagagttattattttctttcagtctaatgggtgtggtggttttaatttgtactgccttgcgtaacaggtgggattgagtatcttttcagtattggacattggagtctcttcctcttttaattgcatcactttgtccttttcttgattttctttggagcagtttttatttttctaatcgactcataggaattctttatatattacagatattgatccttagttatatacattgaaaatatcttgtctcagtctgtgtcttgccttttcactttatcttttctaatctatttcaatatttttattttatttcagttttcaaaataaaaacaaattatggaaaactgagttttatgccttattaataggcaaagtcagatagtttctgtaaatataattgttgtgctcttcctttcttccatataacttccacacttgttaaaactcaagcccaaattctaaaaatatcactgcatttctatgattacagggcaagataagatttatttgggatcatactgatgtgggacacatttcttttcctcttagtcttctttctgcttcagcagaaaagctaattgcttatgcgtttcccaagcccatctgcccagttgagggaagaatctctgtctagctagaggactgctcttctcacaagtctgagagctggtatgcctgggggacatgtctgaaacctctctgctcatgttttatcctgtttgatttcattttctttaagtgcgagcaatgtattttctgtttgtgaataagattagggaggatgcttttccaatacatgttcataaaatgaaaaatgtttggcaatgcagttttggttttttacacctaactaggcagcaggtaacatctatctctgcaatattgcaaaactctttctacctgttttttttttctgtctaacctagaattaaaatagtgctgcatttaaaatattttttcattgtcaatatctttgtgagtttcagtaattccttttcgtcatcccataggcccagtggacattttagatgtggaggaggccatgtcacattcactcagatgtcaatgtttaaggttcctggatggatggtaatatgaaatgtttagaggcagtgtttatatggtttgaacataaaccattttacacttcactgattttcaccaaacagagaacatttctgcctttgtttcctatgctgatgaagccatattcacctctttagacataattgccttaaagtgaaagaagtcattttttaaactctgttttctagaagtctgtgtcactgaactaactgattagggaatgatagagaaaaaaaggctgggcgtcgtagctcacacctgtaatcccaacactttgggaggccgagtcgggtggatcacctgaagttaggagtttgagaccagcctgaccaacttggtgaaaccctgtctctactaaaaatacagaaattagccgggcatggtggtgcatgcctgtaatcccagctacttgggaggctgaggcaggagaatcacttgaacccgggaggcacaggttgcagtgagccaagaccatgccattgcactgttgcctgggcaacaagagtgaaactctgtctcaaaagaaaaaagagacagagaaaataagatctgtatgtaatagttggatgacaaaacccagggctcagacaagaatctagattataccagcttgaagcagatgagaagcccaggaacataacctgaatgacatcataagtcatggggttaacaaactgacattggtagtgtaagagtccaaatccagataaagagccaagatccaaaacatatactgtgagagcgacagtaaagaaccaaactcaaaaaaacaaagccgtgggaggaaagcaaagatcaagtagtagcaaaccaagaaatgatgtggaggctgtttgttttcttaagcaggtaatttcgtttctctgaatctcaatttcatcatctaagaatgtagagattcagttatttgcaagggctcttccagctttaacatgttttgattctgattctagaaagtgaaaacacagaggactaatgttaaatcccgctatcgggagctgtctagtctcatgagaaaggcagaccagcagtcaggcaaataagacactggtatagaatatttaggtggttgtactgcattttcaatctttataaattttctaggtcttggacatacaagaggtagaaaagtacaagtaaactttcccttctaaaaaatcaagactttattttgcctataatatacagataaaagatagtggtcagactggtaaagagtacttaagtgagcagtgtaggaaggaagaaagaggtgagagaatgagaaggaagatataaagtttttaaagtaagagttgttaggaaacaacttctcctacttcaaagagaggtttagacactaacagcaaaaggggacctgggagtgggggaagatagatggtactttaaaaatgggggtagacttattttcctgcataataacaaatatatttctcatccatgcatatatgtactctcccatagaattgatgtagacatagggaatgatatagcatattttagacagcagttcttggtatcaaattatgttgaacatgctttaatggtatgacatgaaattgtaattaattctcacctgcttattccttaagccaaaaatcactaagccacctgtggtccacggaaaattattttattggcaatgctgtcatgagcctttccatagcccacccttacatattttaaacccaacttcatcccctcgaaaagcattcctattgggcctgaaacagctacacctcttccctatgtccttgaagctacttttaacgaatagctaagtgggatgactcccctgtggagtgatattccaatgatcatttttcacttatggagtcctgtttttgctgtaatttctttcattttaatatttcccattaacttgaatcatttatgaaggtaactctatgccaactctcagtgaccagacaaactgaaaacaaatcagtgacctcttagaagctaatgtgggaaatgtgtcctattgctcccaataggatgggaaatattaacacttagggtaagaggttaataaaagctagaacctaacgttgtaacaaattcattcatagagcagaaatgtattttaacattttgtaatacatatataaaacatttataaatatcaactaatatatatttaatgaatacagcaaggattctactgcctaatatctaaatattatatttcataattatgatctgctcactgggcagcatttcacagatgagaggtcaaggctgggaaaacaatttctagaagcgtaagccccaaatgtactttttatagcattttagcaaatcagattactgtatttacccatgttcatctctatcccttaattttacaaaggaggtagtcttataaatgttttagtcaaaagatgtctactgagtacctcctgtgtgctgagaagttttaaaggacagacagaagttggccaggtcacaaaatgaggttgaccttttcaggcagtgggaatcacatatgcaaaaacccagaggcatgagagagcgtggaattattgaagaaactaaggctagtttagtttaaccagagtgaaaggtgcctgttggggagttgagggcagagaagtaggcagagaccactttatgaagggccctcttatattatctgtagaattcagactttcttctgaaggcagtggggagcatataagtgacatgattacatttgcatttcagcaagctaaatctaacagcatcctgaaataaagattgattgaggaatggttaaatctggagacaaggtagttgattaagaggttatttcattggctcaaatgagaaatattggtttactaaaattgtggaagatgaaacaagatgacgggggagaagctgcatcaccagtgtgagcatgaactttagagtctcccagaaataacttttaattccagtattgacctaaaatgaaaaagctgaggcaaaattaatattagtaaagagttcttttgggccagtaaagagtttatttgggccaagcttgagggttgcacttgggagcatagatccaagttgccctgaatatacactccccttagcagcagttacaagtggatttttttaaagggaaagtagaggcagttcctgagctgtttaccaataatttatattaaaataacatactctggccagtgcagtggctcatgcctgtaatcccagcactttgggaggccgaggcaggtggatcactttgagctcaggagtttgagactaacctgggccatgtggcgaaaccccatctctactaaacctacaaaaattagccgggcgtggtggcaggcacctgtaatcctagctactcggaaggctgaggcaggagaattgcttgaactcaggagacagaggttgcagtgagctgagatcgcaccactgctctccagcctgggcaacagagcactccatctcaaaattaattaattaatttaataacataaaatacactatggattgactatatatttttctttgcatcaaaattccaggaatacgaatatattggttgaggcagctagtgagaaacaaaatgacaacaattgccccaggcatggcggggggcatgactgaagtctcatacttatgtctttctggacctgcagacctcacagagctcagattggtcggagctgtttttcttttctcaccagcaataccatttactatctatctctgtggctttagcaagttattaacttccttgaggctacagtgatgtggcacagtccctgacatgagtgtgtatttagcatgctattatgatggtccgatatacgagattggtgaccacttatatgcaggggttgatagaaaggacataatctacagtaactcccataatttcccttcagataaagtggtcagtggcagccaaagcccctgataagttgaagagtgatataaatggcttgtttctcagtaataagagaaaaagtatacaatattatttgtgtacttatttatatttggggatatggtttagaaataggaggagaagctgtgactgtgaggtagagaactagggaaaaaagaaaagctaagcaaggttaatgagacagttggaggttaggagttactctttgtaggttctaactgaaagctaatgaacgatttcaaggatgcaagtaatgtaataaaatatgagaaatataatgagtcaaaaaatcataggatgctaaagctgaaatggactacagagtccattatgttcagttaacactatggctccagtatcttgcaaagaacgtaagcattgctgcacaaaacctaccttgttgttcactcaactcattatctttctgggcagaaactttttgaaagtatggtggtgattttccacgaaatgcttctacagagctagagggatcatttgataaccaattgtagatccatcattaaagaatgttagtaaacacctcttgaactgatttagcttatgtttagaagttcaactttctcctgtataaatctctcagtttaacttatactgcatacctaacttttagctgttggcttttgttaatttccacctgtcattacaggacataatttccattgaaccttcctttggctctttttagttattttttattaaaaaaagatgtgccttaatggtcaaaatgcacgcaaccatttgttttcctcttacatcgactaatgaccaataataataacatctaaggtttattgcatacttactatttgctagacattgtttcaaaggctttctggctggctgtggtggctcacagttgtaatccctgcactttgggaggccaaggcgggaggatctcttgagcccgaaagttcaagaccagccagggcaatatggcaaaaccccgtctttacaaaaaatacaaaaattagcccagcgtggtaatgaaggcccatagtcctttctactcaggaggctgaggtgggaggatcgcttgagcccgggaggtagaggctgctgtgagccgagactgctgcactccagcctgggtgacagagccagaccctgtctcaagaaagggctttctatatgtaaattcctgtaatctttacatgagatagatactgtttttattcctattttatgaaagaagaaaccaaagccagaagacttaagtactttatgggtgatcagacagcaagtgaattacagagcctgtactcaaacacaggcagtggcagtctgagtctggagcccaagctcttaaccacctcatcagactaacctctaacttttgctggctaagaaactgacactatattgaacattacacaacactggtctattcagatataattatgattcccttaacaatatttatttatctcattttgcctctactaaagccttcatacaggcagttatttttgttttgacaattgccttaagatgcatatgttttcatttgcccaaattttgtttaagtttttgttatgaacatacacccacggcaatggcaagagttgcattaaaagagggggaggagggataaataaataaataaggcctcccccacttcttgtatctcgagggactctgggatgtgataaaacaaaacactgttaaaaattcatactagtaacttgcattgtatattatgcactgcaactaaactttttagtgtctcggcaaagccctagagcagccgagaggtacctcagagcacagaaagcacatttgaaatggtaatgagaagcgagccccgtgacaaagtgctagtcggtgaaatatttctctgagacaaacatatatttggagagggtagaaagtcattgactgctgccataccatgacctattttaatgttttcttttttttttgtccacactatactcagttgacttcacagagggcacaattttaataatgcaataaatgccaggacatttgaagtttgagagtaacgtgttacgttattagttctcaggatgtcaactttgggtttcattgtttggaaacagcagcagatcctctattaaagtacttccaaggtttagaatccttgaagtaccactctgttttaaagataattccgaagttcttcttcatcatgccttaatagactgtaaacttgctttttctctggaccattggataaacagtgagtgaatttccttacataacaccattttgctggtacaaagtttgttaaagtctcagtcttctgtttgctaatgaataaaataaaataatgaaaaagaagccgcttccaaatttgcaagagtcattgagtaccgtttctcatcacacacatacatgcttcaatatttagtgcagcccgtgggatgcttgtacaatgagctcccttaaatcagctgaactttcaggtgctcgaggttttgttcagaacttttgagtaagagattcagagagagaggatgcctaggaagctcttagtttgagccctgagaagaaatttaggctagggaaagaggaagggtgcagtgggttgtgaaactaaagaaacactctccagagatagagcactcaagacacagaaaataaagtcgtgagagtgttgctttcgggataaggtaaaaagacaagggaaatgcagatcttcaaaaattgtccttgactaaggcaaaaacaactctggactggccctgcactaaatcatcacagcccattacccccaggagctaaaaacgaaaatacctaaaaacgtggaacataagcaaacaaaagccagcatggaactccagtggcttatgacatatatgtgatgctcttagcccccctgcagaggttttgtggagttcagtgtccaaactttgtaaaaatctttgtgtgtataagaggtgggaatggtggtagataggctccacaacctgtttagaaaaagctttgattttttttcttcattatacgaataccatagcccttcattaatttgggaacaaatgagttcacacgcagacttacctagcatcccagtaaacagtctttcccctgcaatttgcaggatcacagcctcttgcaacctgagtcgacccaattatttctgagatcaccaagtatctcacatgttcaagatcaatcttttcatgatttccattctaaaaattatgttgatgatcactacatggcaagaaatccaggtggccattgccataactaatgataccctctttgagtgaaccctttcctattcaggactcccaaagccacccatctctcaatgcacgacgttgctactgcttctcagttctcactgtgttgccagagccatactatgtaccaggcagaaatggggagactgcccctctcccctgttctgtgtcaaatgttttcgctcagtttctgaagcagcaccacttatgctcctttcttcatgaactccttcaacctttgtcagctgcacttatcaatgtatggactcagggagccaggcagaggacatgtgtcatgccaagccacgtccttatttcttcatttctagccccacacatttcccaccacaaatttgcatatgacacatgtcctcaaacacctcttcctgctactttctattcaattaactaatgcaaataaactcccctgggagatgttatatttccccatgcccactcttagtttacactaagccgggaccacctaactacacaggtgtcccaagtgccaccgatagtactatgtttgaggtacgggggctgaataatttttcccaggttttatgaactatcaaaaggcacacaatgaataaatatttatgaagatgttttaattttgggagggatggggtagacgtagatagggtttgtgatgaatattgcccacagattataaatacagataacatacaactaagagcctaagcaggtctaacttttaagtttagagtgagaacacttacaggaaatagtgaagttgtccaaactaagctctcttttgtccttcatttgaatctctcacccactaccttttgttgccttggtcccttttaaagtagaggccactagtctatgtatactatgcccctgagatgaggaatatggtggcttgaagaatgtaatatcttagaggacacagagtgtgtttcatgtgtatctttccatcatctagcatgtgtgtactcccaacgaatattaaaaaatagggtgtgaccctcttaaccataagagatgattcctcattttgagatgacgtgctctgggaataaagaatgcttccttcattttccgtgactgtcaaactggcatctttcatcagcactaaattcccttttaagtagtcaaatgccttacacagttttaacaggaaatctctcagcacctctagctatttgttgaaaagaaaacaactcttttttttagatacatcttgcagaaaaccatttcccaaataaaaatttaaaagtgttatcatatttagagggaaagaaataagcccctgaatcatagtgccagtttcatgttttccttaatgttgcaaaggtgattatttttgccataatcttcttctggctgttagcccaggatggcaggctgcatagctgccttgttaaataaaagagaggggagactttcttgaagccattttttagaggatttgtacatatgtgtgtgggaagagtgtgggtgaaatcctcaggacaaaaatttcccatctactacttccataataattcatgaaaaaatgagttctaccacttgttattaattcaagtcctggaaatatactctaatcatcaatatcgtttccaaagaacatataaatatagtggtgtgtttcaaactaccaaagaacttacactcaggatgcattttgcatctttctttcttttgttttctttctttctttcttgtgtttagctggaagtcagtgttgttaaataaggagagatacaggcatatacaggatggattagttccttgccctcagccgctttaataatgattttttacattttttgatctattcaaatgtgtacagtgctaaaaagaaatttatttgaaaaggatctaattggcatgagctgccattgctgtcacactgaagtcctgctgacaaggctgaggttggcagagaaataaaagcaactgttaatgtcagaaatgagttgtggtaaaacatactgtttgtttaatgttgataaaagggcaggtggaaagtacatgaaattatcttctcagagagttcttgactcataaactgcaaatgctcactagaaaataaatttatgttttatttagttgtggctaaaacaatataataacaactatactaggagtatagcatagagcgggcactgctattatccgtgcttgtgccaaatagatctaagaattgtaaagaaatgtgtttcaataagatgatattctcatgtatcctatgactattataaatacttaggtattaatatcagagcagaaggattgtggtatttctgaaactaaccctagattaagatcatttactgttagaaatgaaaacattgttgaaaaactgtaaatgtttgttaaaacctgtttttaaatttttttatattcagttttaacatctgttacatttctttctgattactcttaaattggccatgactcctgattgtttatcataagttttaattctctactttccttatgtcatctgaaaattgtagcactggggcccttcatattttaaaggttgtcttctgttgaaatatatacatataaaggattgacctgcagtgtaaataataatttacctctttttatttattctttaagcctgtgttaaatatattgagttttcttaaagagggaaaacctgtgaatagttaactcaggccaaaggtattttaagttgtatgttaatttctttatgcagtaaagctatgaagctctgacttggcattataactatgctcttcttggaataataagggtacacgctgcttatccgattgacacttctttcaaaagcagaagatatttttattgactttggtggcaatcccatattcagggcttcctccatataaaaaaaaataataatgtgaaccttgaccacagggaaggtcacagaccttggatagaagccaaatatctgtgttttgtttagggccctcaagcaaaattttcacacaggatttcctcagattcacttcactgcaaaataaaggcattttcactccctgccaggtttagcatgagaagcccctttgttgtggggctgcttgagcagtatttacacttccttattgagtacctgcaaatgtctcagctagaaaagtgaaagtaatccaggtaggcttgataaaaaattttaaaaaccaactgggcgcagtgactcatgcctgtaatcccagcactttgggaagccgaggcgggcagatcatgaggtcaggagttcgagaccagcctggccaacatggtgaaaccccgtctctactaaaaatacaaaaattagccaggtgtagtggtgcactcctgtaatcccagctactcaggaggctgaggcaggagaattgcttgaaccagggaggcggaggctgcagtgagctgagatcgcgccactgcactccagcctgggcaacagagcaagactctgtctcagaaaaaacaaacaaacaaaaatttaaaaacctgcctaaaagttttagcaagttcatctttcttggcttgctttactcttgcaaagaatctgtaatttggagagaactgactcatttttgctattagaaacatttttttttaaacaccagtaatggaagaaacaaccaagggatgaggaagtgagcaaaaagtgtgaccttcccaaatattggtcctgttaataaaactcagattctaaactgttgatgtcaagtcatttttaaatgttatttttcctaatttttgagaaaatagatgatcattttagaaaatgtagaaagtacagacaagtgcatttcaaaagtacagaaaaatataaaaatgcaaggggggaaactattctgtcacaacccagaaagaacaactgctaacattttggcttatttgcttgcagatttctgaattttttacataatttggatcatattatttatgtaatgttacatcttgcctttcgtttaacacttgccacatgtaagttctaacatctgtaaataattttttggaaatcattttaatgactctattatggctcataatttacttaaatattcccctaacagtggatatttagggtgtcttcaattttttggcactctaaataatttttttttttttttgagacagggtctcactctgttacccaggctagattgcagtggcaccatcacagctcactatagccttgatatccctggctcaggtgattttctcacctcagcctcttgagtagctagaaatacaggtgtctgccaacacgccaggctaatttttcaatttttaatagagacgggtttctccatgttgctcaggctggtctcgaactcctgggttcaagcgatctgcccacctaggcctcccaaagtgctgggattacagttttgagccactgtgcccaggctctaaataattctacattgagcacttcttgcatgtatctttgcctacatttcaaattatttcagcagtagagcttccagcagtaaaataataggtcagacagaatagacatttaaaaattttctgctatatggtttcaaattaatttacagaaaaacttaactaaattatgttacaaccgatagtgtatgagaggacctattactcactttcaccagcactgaattttatttttttaactgtgttaatttggtgagcataattaccatttctttctttgaataattttcaaactaatgtaaactcaatggcacacctgacggctacatcctacaccacaggcccttctgaaggagacaaggccctttctttacagtaagaatcacctattaagtatcgatgcatgtttgaaataatatttttaaagtatattatgcaaacatatataagttaaatgcaaagagtggttaattggggattagaaagaatcaaaaggaaaaacatttgcataattaatgcttgcttcttttctttattttcaatcatggatattatagcccacaggattaaaacttaaaatgtgcagaagtagcatatctgaattgtttacatcttttgaaattgatatgtcctatccagttttccacctaaaaggagacaaagaagctgggcacgatggctccagcctgtaatcccagcactttgggagactgaagcgggtggatcacttgaggtcaggagttcaagaccagcttggccaacatgatgaaaccctgtctctactaaatatatatattatatatataaaataactgggagtggtgctgggcgcctgtaatcccagctacttggggtgctgaggtgggagaatcactggaacccgggaggcggaggttgcagatcttaccactgcactctagcctgggtgacaaagtgagactccgtcaaaaaaaaaaaaaaaaaaaaaaaagaaagtcagcttatgtatgaaaaagaaatttgttgatttctactaatagaatatcatacaatccaaaatcaatatataagataatgttattttccttactttcctgtgtctcgtcacgttcccatttcatcatttttacttcagtgtaagttacctttgtgtaatgaggaagaaatctctgtcctttttaaaattttatttttggtaaggcaagatttaggatgtggggttaatttatttctggaaatcctcaagttggccaacatcccaccctaaagaggaacatgaatctgacattaaagtgtgaaaaggtaagaagtaatattgcacattagtagtactacacagtatatggattgtgtttttaatattcaaaatgatatcctcctctgattttatctggacatggtaagaacaactttgcagtggttaagagtggttagattttgaagccaaacactcatgattccaattttgctgctgccttttaccagctatatgatcttagacagtttaacatcttggaaactaaatgtgttttaatctgtaaaatggaaaatgttattacctctcaagctggatgcaaagatcataaaattattgggaattaggtatagcacacttttcatcgcagactgcctgagtacaggcatgtatgtggcactccttcttttacttaagctgtttggttcttccttccatcaggtggctactaaccacacttagtgttgtctttttgtggctgtctatgaagtgcataaagaaaatgtgtaaagtgaatagagcagttaagaaaaatagatgctgacagatccatgacatttgcttcatttaccattaatcagctgagttaaataaacagcaattatttttctttttttcctttcctgtcaccagacagttaatcaaactgatttcagtttggagtttgcaattttctcttaaaagtttttaggaaaaattttgtcaaaaaagcaaattcctcataaaatattttattaaatattgataactatttcaccctaacattttgtgcagttaaatgtaaatgaaataaatgtgaaggcatgaagacaaataaagaaaggaaggaagtcctataatgtaggtctggttaaataaatcatggtgtacctataccatacagcattatgcagtattagctgaaatgctttagaaaactggcatggggtgtttttcatgatatgttaagtggaaaaaagctggtaataaaacagtatctatgtgatgatcataatttcttgaaaaacatagttatgttttaaatcaatgagaagaatatccactcaattgttatgattatgattgcttatgattgttacctctggatgacaagattttttttcattcattacagaattttatctttagtatagcattttaatattgtttctaaattttatctttagtatagcattttaatattgtttctaaatttgtgtgtgaaacctatattacttttgtaaattttaaatttttttcacgaggaaaaactaaatctataagagtagtatactcacatactactcttttggggtccatagttaaaagctactttttagtatttcgacttctgtattttaattttctcctttgccgggcaaaaggaattaagaaatgttaatgataatgatatatcaaaacacaaagacaaaaaaacttaagtagtctgctttgctccaattttcctattttacattgatttagaatgatatgcaaaaaataataataaatcccagcccaagatcccatgtgcaaatttgtcagtatatttatttgtttctacataatttatttgaggatcagctttactcaaatgatcactgcctcatgccagactctgttataacacatccgtctaattaatttctctgaaaatttcacttgaatttccgtttttaccaatgcctattgccctttagtaccaaatataacatgtagatgtctaccatattataggaatagttgtgagatatgaagacaagtaaaagaaaagcaagcagcttagtataacagtgtaggtgttagactcaaaatagtacttagcctattagcatttgactctagcaagactttgcaagaggacaaaagttgttaccaatgagcgttttcccacaacccagttaggacttggtcataagtagaatgtaagctcttcagctatcatccattactttcctatatcttcttggttactatgaaattctggaaacataagacataagatagcaggattgtaggtaaaagttttttgcattcaacctgttaccgattctgggtcctagattcttttctgcttctgttgcccatgacaaatgtgtgcttgctccaggcttattcagctgcaacactggattatagacaaacagcatgaagctcaaatgtcccagtccttcgctcggtcaataagcacttcttgagagaggcacagtaccagcactttacaggttacacaggagaataagatatgaacttactctctggaagcttgctctgctagaagaaataagatatataaaaacagggcttataatatgaggttagaaaatcagaagtcctttgagaaaggggcaaataagttcaagtgcagtggaagcttgaaggtaaattggaaaggatttgtggagaagttccatttcagttatgacctacagtacaaggagtactttggcacaagtgaatggatgcaacagacacatgtaataaactctttaaacagtctctggtatataataagcattagctacatttgttagagtaaaaagcttagttgctgtaacgaaatgacacaacaaagattgtttcatgtaacagtccatgaggtgtgagcagacactgctgcacacagtctgtcactatgcagggaccaggattcatctcttcatgttcttccatcatcctctaaaaccattgttatcatctgagtatttgaaacgattcctaccacatcctaattctagcaaggagaaaggggaaaaagtgttaggagtatacttgtgatgtgttaaggcttccattggtgagcacgtagttgcctacctgaactggggctggaaagtgtgttctctggctgagcagtcatgtgatttctataactccattaccaaggaagaaaaagaaaacagattttggtggatagctaatagtctctgccccagctattattattatcattcttgaacaatttgttactatcatcaggccataattgtaccctagtaatctgtgatggctagttcatctccccaaacagtgaattttctactgtacaagtggcttaagcccaagatattcttgtcactattcccatggaatagaattcaaaccattcccaaagcctagctaaagctatcactgagtaaaactctcttagcttcttaaagttcatatatttgtccttaagtgacctaggctgtgaagaaatgggtgataaaagtgtgaattacagaaccagtgcttccacctgcactgaattctctgctcttctgaagaatatttctcacaatagagtgtcaagggaagattggttgaacggttttattctatactaaattcttctcttttgcttttaaagagtcatttgccagaagaaaacctcttcagcaagttcatttcaacatttcaaataatagttctcttttcatgaactattttgtagaaaattacatgggtaataatatcatgggaagagtatagctttcatgatgtgtattttttctaatcgttctaatttttcatggtaatctgaagtgccatatcatcttacccaagctcaggaattgtaccaattggggattttgagtgcttggaagaaatgtctatttttaagcaacttttcattctctatcctgttaacatagtgatttatttgtgactcagaaatggaaggacaagccacctctctgtagtgatcacctgtcttatggaatcttaattgcaatgctaattcagtcttggagttagtgagatagtcaactaaatgataagtacaagatattgataaatgacaagggaagtatttagtaagtcattggtaagtctgttttatcttaatgtgttgagaaatttgaaaattaggagaaggaaataagagcatatttatgaaattttctaaagtactgctctgtcccagatcttgtggtagatgctgtggagggttacgtaaagaagggagattgagctcagcctttggttaacctttgccttcatctaatagaagacaacatgtacttaacaaaaggggaagcaatactggtaaggcaatatgttaagtgtaggttacatcagaaggcaagaactggcctgcaaggcagaagatctggttctcaggaaggatatcaccaactgaatatgtgaccctgagtaggtttcttcttctctctaggccttagtttacccacctgcactatgagggagttcaattaagtggattatggcccctaacagattatgtgattatttgaactatgtaaccatatacatagtataaaatgcttacttacattgagagaatgcagagtactgagactaaacagtacaagtgtgaggagttcacattctcactgatgacaagccttaatggacaaagattacataagatttttgagtgattgcattcaatgaacttcaaggacccttctaatgctgggactttgtgattcttggtaaaatgtgagatcccacttgctcactaaaaatccccagaagatctaaattggatgctattttcatgtctgtctctactcatcagttgaattggagagaacccaaatgaaatgaataaaaatggaagatctgtggtgggggggcggctgggaggaaggatttctttcactttaggtaagataaaactgtataaggaaagacatgaaagtaatgtatgacttactgaaaagtgtaagtaaaagccagtaaggaagcaaaatgggttgtctgagaccgggaagaattgaaatgaaaatgatgggctgcatgttggagaactgaaattaaggcaaaatactaggacaaaaacacattgacccatacgtgaaaagggaacagagccaggcggggcagctcactcctgtaatcccagcacccagcgctttgggaggccgaggtaggtggatcacttgaggtcaggagttctagaccagcctggccaacatggtgaaaccctgtctctactaagattagcctggcgtgatggtacacacctatgatcccagctactagggaggctggggcatgagaatcacttgaacccaggaggcagaggttgcagcgagcccagatcatgccactgcgctccaaccagggaaacagagggagattctgtctccaaaaaaaaaaaaggaaaggaaaggaaatgttactggaatattttaaagtcatatagcccagtatcattcagattaattaaaaatcttggagcttgacaatttcgtggtgctgatgagtgagagagggctaagattagcagtagctaaagaagggaagtttcctacaattatgtaggccagaaacagtttcccccaccctctcacgccgtatgttctcttgcctcttgcctgaggaagagccactattggtaaagtttgatttgcacaattttgtagtaaagaaataattagagtttaagactgtagatgtcacaccactgagaccgtatgatctagtgccaattctagattctggtctatactctgccaatgataggccaagtcactaaacctctcccacataagttttctcatttaatcaatgaggacagtcacttcatggggtaaaatcactttggaatttttaaggtgcaatagaaactcactaatttcttgtaccttctttctgttcttcctcttattttaagtgacttggttcataagactgtgcaatgaaaatatttttaaatttaggacttattcaagcacccagatggtttgaaattcagatgaatttcaataattattttcatgctagccattcttgattttgctgtcaataataacacatagtcaatttaaattacactgaaatttgtggttgaacttttaaatctttgttggattatatgaaatttatattttctccccagaatcatgtcatcattgtcttattttgcctgacattggcctggggtgcatacccttgcaataaccttactctgggtttactatgcttgctcttaggcaaattgtttagtttgtttttaatgtttaatgttacacaacccaacagctttctgttgtgtactgacctgaaccaattttatcatgcagaatgcttaggttctttttgataaataatggtaacctccaaagaagtcttacggtggttgagggtgactctctccaaaatctcactatggggttatagtcaaagaaaatctcaaaccaaatcctaccacaaatgtttattatttaaacatttattagcatttcagtacataaaacagttcatgtaacctgttctgtaatctcaagaaaatcctagttcactatcctttcaggtatcctttcaggtgctttagagattaagagagacaacttctctaaaggagaattataaagagtgtatgtcctgccatataatagattttcctaatagtgagagaagatatatatagccatggtattaagttcagagatggtgtatccttggacattggtttattgagaaataattatgatgacaatgataatgattttgaaaataacaataaaatagcaaccgcattaccgcctcacatttatacctccaaaagataaatttcgcaagggcaggaatgttgttttatataccactctatctccagcacatagcattttgcctggaacatagtaggcatttagtaaacttttgttacatgaaccagtgaacaacagttacggaaaacagtttgacaaactgatgagtcaggcagtgctctaagctctttacatgcattatcacattcagtacaaatctgtgaaagagccaagctaaataaagctttcactaatatcagttttcaggaaatgaagtatactaattaattgaattttctggttaacagagcgttacatttcaattttttaaattttaatccttttaattgcaattaaaaaaaaaaatcagtgacagccctgcctcagtaaatagaatctagaagacattcttgaattttaggatagctgattgaagattttctcagggccccagatgaaactccaagcatcaattgttttatgcagtatcttaaacagaaaatgtgtaatataatacattagactaaatgtataaataatgccataacattctctagaagttgtttttcttttcttttcttctttcctgggggtatgggtgggattatgttgttgaagctttaatattatcttgttttcctctgccaactctctcattcccttgtacatattttatggagagccagtaaatagagcatagtggagaaagcgaaggctttgaagcaggaaatgactgcattagaatctttgttctgtcatttaactgctgtgtaatttgggcaagtttcttaacatctcagagccttagtttcctctcctgtgaaatggaggtaaaaccacttagtataagatttcctatggcgattgaataaggtcctgtatgtaagggtcctctgacatagctgctgccactactgtgagaatcccaggatatagggtctgaaggcaacttaaaaatatataacttgcttcaggaatacatgaaatatgatgcacaagtaaaagaatattgtttgaaaatggcaaattttaattttactataaagacacatgcacacgtatgtttattgtggcactattcacaatagcaaagacttggaaccaacccaaatgtccatcaataatagactggataaagaaaatgtagcgcatatacaccatggaatactatgcagccataaaaaatgatgagttcatgtcctttgcagggacatggatgaagctggaaaccatgattctcagcaaactatcacaagtacagaaagccaaacaccgcatgttctcactcataagtgggagttgaacaatgagaacacatggacacagggaggggaacatcacacattggggcctgttgggggttgggaggctaggggaggaataacattagaagaaatacctaatgtagatgacaggttgatgggtgcagcaaaccaccatggcacgtatatacctatgtaacaaaactgcatgttctgcacatgcaccccagaacttaaagtataattttttttaaattttaaaaaaagaaataggaacattgtttgaaaaaataaattaagctattattaaaaataataataaaaataaaaagaggaaaatggcagattttatatggaatgtatacaaatgattaattagaaaggtactttgttccatttgtagaaaatgacaatgataaaatactaatctaaggtaatttttttgaatcttagagcaaatggtccattttataagttttctacaggaaaatgtattaattctgaaaccattaattatttatgattatgagtacagtggctgggctgcatctccttgttctgtttaagctgtggattgataagcaaattcagacatgaaataagatgccagagagtataaaatgtttgagagaaactaaagtgttttcaaacactttataagcactcatttacatataaataacatgcaaattatgagtcattcttctgtatttccaaaagcaagtgcttaaagatattttattagcctatgttgaactattgtatactttgaatatggtgtgagtacacacacaaatgcatgcattcatatacacatacatgcattcatacatattatgcatttattttttaatgatctgtagttcttacaaactttttttgcaaattggtctgagaaaagtttattttgtgtattttgttttatcaacacctattttatcatctcctttcttcccagtgatgctgatataactaccattttatgcccaatgattgattttgtctttatggcagctatatgattatctttgtgatcatctcttgaatatattcacaaatcaaataatttccaaaatattcaagaagaaacacaaacgttttctattcattttcaaacttcaaacccaattctttttcatcaacacacttttacaatattttaaaattcttttacttacttccaaatctacttaacccctaaagaaactttctttaaaactgcttaaaattggaaacaaataccatttttcatacagaggaatccttctctcagctattttaccttattttgttgcatagaagtctttctattctatctaatatttaaataaatatttacagagtctcttcagattgtttcattcaataattctgtttcactgaaccattcgcaatgttttaaatcagctttattttctagagtacagtgtttaattttttttctttattcaactaaagtactcttttttaatgaacagagattctgttattattgaaaattgactctaaaatatgaaatgctgtatacatactgagggtattttaaagaaaaaaatagaatctgttttgcttctgcccataatttttctggcaactatttcaaaggacaatcgttatttaaaatttaatattgtctagtgttttagaaagtcccaattagaacattaaaatttgttgtataatgaaatcaatgttggaaaaaaactccctagttttagcagagcaagtcagttgtgtcttggttttaggtaagcttctttaatgcaatgttttattccataaaactgaaaattgtcttttggatgctgaagaacactatgacttccattgttttgttttataatatgtttgcaattgagctacagcatataatttgatagaggataaatagagaataaaccttttattttatgcacattggtttcatgaagtatataaataagcatttctaaaaccctgagctgactctgacagacccaagatattgatgcagtagcctaccagctatccacagccatgcatagcctcttgaactcctcattaggaaataatgagggaacagtcataaatacatgcaattgattatgcattactactgatgcttacatttgctttcagtactgtttaggccaactctaaactttaaattaatagtttgcagcatttactgatgaaaacattggatatacaccatctagacagaaataacttgtttgtttgatttagtgaaaatgttaaatactgttaggacttagttaccacaaacctggcattggaggctactttcagctttagcttatacccaaagggctgttaaataaggcaggtcaggaactggaattattcctggccaatcatatcctgcccctcccttttcctttatcacacccctttgtgtttaccctactctatcagtaaaggtctaaccaggaaagtggaaatataaattaaaacagggagactaatggaacttggttacgcaggccatggaagaactgagaagctgaatatgggacattgcagccacctaactataagcaacaacagggagcaacaccaatgcatctagggtggagggacaagggaagagtcagctgatatggaaaccttggaatggggagctaggataaggagcagagaaggagaaatatgatctaaggacatggatctgaggacaatcagacccaaaacaagcacagttgtagtgggctactgtaaggaaaatgagagaacaaaagtgtgaaaatgagtttgaacccctaagaagtgaataagccatgttaataataataaacaatagcaataataatggtgatgacgataacagcagttaacactcatggagcactctgtatcaggcattgttccaaacacattatccattatgtctattttgtcctaacatagcctagtaagttaggcactatcttcattgtgcagatgaaactggggtatagttatttagcatgtccaaggtcacatagcaaggattcagacctaggcagcctgactctagaaatgaagctgttaacttctgcactacaactgcctcccaaaaggtaaactatgctgtctccctcttggccattctatccttcagccatctatacaattgactaggtcttaaattcatttgatgacactatactaattctgttaagaaataataaaatcattctcatgcaatgcagctttcattaagacacttctttttttttgtaataggtagcacatgcacgtggtagaaattattctggtattttttgaaccatatggaattgctgcttttttatgtcaaaaaagttgcatattggcatttttttatagttcaacctaatgtagagggcatgcagtaaaggcaaatatctccctcaccccagtttctctgaaagccaccactccctccggtttctaaagtacctttagagagatattctgtaaatatacaatcacatatgcagatatttgcctcttttctgcccaaatagaagcaaactgtattcactattcaacatcttgcattttgtcacttaacagctgctgagtttccagttgcacaactgtactataatgtatttaaccagtacttctcaatggaaatttaagttggcttcattgatttgttattacaaaaacatactgtagttaatatatttatgtgtgtgcctttacacatgtaaattactagaagtggaatttcttcctaggtatctgtgcattttttattttgataaatattaatgatattggacaaatattgtcaaattgccctccatagaagtttgataaattggaattcccattatcagtttgtgagagtacttgtttcttcaaatacttgtaaacataaggtgttatcaaactttttaatcctgcccatctgataaacactaaatccaatattgctgtatttttattttgcatttattttattatgaaggagaggcagccatttttcatatgttcaaaagtcagtaatattacattttctgtaaatcattcagattgcttactatgttggattgttggtcttttattattgatttgtagatactatttatatattaagtaaagtagtagtcatttatttgggatttgatttacaaagacttttcccagtttgttatttgtcttttatcatttctgtgggtatgtgtgagtgtgtataattgtttttttaaatgttccatgtaatttaaaaatgcccctcctggaaaaagcaagctatacctgttaatcaagaaatctaaagaaaaaaaagttctatttttaagaatttctaaattggctggctcatttgggctgtagttgagaaagttctagtggttttacttattttaatccaaactactttcttacatcatgtatttccatttttaatttacattttttaattctaaagatgattttatatatgtgctcattgtatacttggaaaactggcatatgaggaaggaaaaacatttttccttgttaccacagtctattcatataaaggtaaaaatagaataagaaggatcaatgaagtccttcagcattttttttattgtgatctctgtttctgatttgtagaaacaatttgaaagtcttttcccaaaagtgatttataaaaagttatcaagttttgtgataatgatactatcactaatcatactgacaaattcatgacatttgctagatagacgttagagttgcatggatctataggaatgtaaaataaatcttcatatttagcaataattgagattacttgtttcttttctttcctgacacatatcaatattttaacaaattattcataatgatacattaaatgctatcttattttagcttgttcaaatttttattattcatttattttcaaattgacagacaaaattatatttatcatgtacaacatgagattttgaaggatatacacattgtggaatggctaaatctagctagttaacatatgcattaccccacatagtcatcatttttgtggtaaaaacaccatatccattctcttagcatttttcaagaatacaagatactgtcattaactgtaatcaccatgcttcataatagatctcttgaacttattcctcctatctaactgtaagtttttatcctttgaccaacatctgctcagaaaatacaattttcacttctggaaaaaccattctcaacctcacagactttggtagtcttcattctattatactctctacttctatgagatcaacttttttagattccacacatttcgtttaacataatgtcctgcaggctcatccatgttgtctcaaatgacaggatttcctttttcatggcttaattgtattctattgtgtatatatgccacattttctttatcaattcatctgttagtgtacgcttaggttgatttcatatcttgactattgtgaatagtgctgcaatgaacatgggagtgtagatatctctttgccatactgattttatttcccttggatatataccccatagtgggattgctggattatatgacagtcttatttttaattttttgagaaatctccatactggttttcataatgactgtactaatttgcattcacaccaatagtttgtcagggttttcttttctccacgtccttgccaacactcgttatcttttgtctttttttataatagccatcataacaggagtgaggtgatatctcattgtggttttaatttgcatttccctgatgattagtgatgttcagcatcttgctatatacttgttggccatttgtgtgactttttgagaaacactgattcagaccttttgccaattttttaatcaggtaatttgttttcttgctattgagttgtttgtgtttcttagatattttagatattaaccccttatcagatctataatttgcaaatattttctcccattctataggttgtatattcattctgttgattggttcctttgctatgcagaagctttttagtttgatgtaatctcatttttctattattgctttgattgcctgtgcttttgaggtcaaatcattgcccaagccaatattatggagatttttccctgtgttttatcctggtcattttatagtttatccactttgaatttatttccctatatggtatgaggtaaggccctaatttcattcctctgcatgtggataccagatttcttaacaactttattgaagagattgtcttttccccgttgtgtgcccttgttgcctttgtcaaaaatcatttggctataaatccatgggtttatttctgggctctctattctgttatgttagtctatgtgtctttttgaaattgctggtgctgagctgttttggttactgtaactttgtaatatattttgaagtcaagtagggtgatgactccagttttgttcattttgctcaagattgctttgactaattggggtcttttgtgattccatatacattttagaattttttttctatttctgtaaagaatgtcattagtattttggtaggaattatattggatctgtatatcgcattgggtagaataaacattttaaagtattaagtctttgaatccatggacacaggctatctttccatttgtttgtgtcttccatttctttcatcaaggttttatagttttcattgtggagatctttcacctccttggttaaatttatttctaagtatttttttgtaactattgtagacaggattgtttttctttctctttcagataactcattaagttggagaaacactactgatttgtgtatgttgattttttatcctgcaactttactgaattcctttatttgttctaacagcttttaggtggtggctttaggattttctatatataagatcatgtctacaaacaggaacaacataacttctttgttttcaatttggatgccttttatttatttctactgtctaattattctggatagaattttcagtactatgttgaatagaagagatgagagtgggcatccctgtcttcttccagatctcataggaagatatttcaatttttctgcattgagtatgatgtaaaggtgagtttgtcatatatggtctttcttctgttgaggtactgaaatggtttggctgtgtgtccccacccaaatctcatttcgaattgtaatccccacatgttggggcagtggtctggtgggaaatgattgggtcatgggggcagacttctcctttgctgttcttgtgatagagttctcacaatatctggtcattttgataagtgtctggtgcttcctgcttctctctctctctctctctctctctctctctctctcctgctgtcatgtaagatatgccttgcttccccttcaccttctaccatgattgtaagtttattgaggccatcccagccatgcagaactcagagtcgattaagcctctaagcctctttactttataaattactcagtttcaggtatgtctttatagcagcgtgaggattaatacaggtactttccttctatccctaatttgttgaaattgtttatcatgaaaggatgtgccaaatgctttttctgcttttattgaaattatcatatgtttttgtcctttattctcttaatgtaatgtatcaaatttaactgatttgcacaagttgaatcatcctttcattcctgtgatgaatccccttgatcatggtaaataacattttcaatgtgcttttgaagtaggtttgctagtatttcattgaggatttttgcatctgtgttcacctggagtattggtctgtagttttcttttttgctgtgtccttgtttgatttttgtagtgaacccatcaggtcctgggttcttctgtgatgggagactttttattacagaatcaatgtccttactttctattggtcggtttagattttctatgacttcattattcatgaataattgaattgaatgtatcaaaaagtgtatccgtttcttctaggctatccaatatgttgacatataattgttcataatcatatcatgaaactttgtatttctgtgttactagttgtaatgtctttttcatgtctgattttcgtttgagtcttctctcagtctagctaaaggttcgttgattttatcttttaaaaaaaacctctgtttcattcatcttttcagttgtttttataatttctattttatttctgctagttctttattattcccttccttctgccaattttggacttagtttgttcttgtttttccaattccttaaggcaatattaggctgtttatttgagatctttcttcttttttgatgtagttatcaattgctataaactttcctcttagaaattattttgccgtatgctgtaggttttggcatgctatgtttcatgcttccattttcatttgtctcaggaaaattttaaattgcccttttaatttcatcattggcccactggttattccagagcatgttgcttgatttccatgtatttgtgaattttgcaaagtctcttctgatattcatttctagttttataccattgaggtcagaagagatacttgatatgatttcagtcttattaaatttgttgactggttttatgatctaacatatctatccaggagaatgttccatgtgaagttgagaagaatgcacattctgcttctgtcagatgaaatgttctaaatatgtccgttaggtccatttggcctagagtgcagtttaagtctgatgtttccttattgattttctgcctggttgatccgtccattgctgaaagtggagtgttgaagtctcctattattgttgtattgcagtctatctcttccttcagctctactaatatttgccttttatatttaggtgctctgatgttgggtacacatacatgtacaactgttatatcctcttgctaaattgacccctttatctttatataatgatcttctttgtctatttttatagtttttccttaacgtctattttatcttatgtaattatagctcctcttgctctgttttggctttcatttgcatggagcatctttttctaccacttcactttcagtctatatgtgtccttatagattatatatgtctcttgtaggcagcatatagctgaatgttgttttttattcactgagacactctgttttttgactaaggaatttaatccatttacattcaaggtgaggacttactgctgccattttgttaattgttttctagtagttttgtagattctttggtaccttccttcctctgtgtgtgtgtgtgtgtgtgtgtgtgtgtgtgtgtgtgtgtaagtgattttctctagtgatatattttgattccttactttgtatttttttgcatctactgtgtgtctttgctgtgtgggtaccatgatacttacaaaatatcttgcagtcataacagattattttaagcttatcacaacttaactttgatgacaatttttaaaaactctacacttttactgcactccccccacattttgattttttaatgtcaccatttacatctttttatattgcataccacttaacaggttattgtagctattattttaatagttttgtcttttaaccttcatactaaagtataagtgacttactcaccaccattatagttttagattattctgaatttgactctgtatttgcttttaccagtgtgttttatactttcagatgatatcatgttattcattgacattcttttcctttagtttttagcatttcttgtaaacaagatctggtggttatgaactccctctgctttaatttgtctggtaaagtctttacttctcattcattactaaaggacagcttgctggcttgcagttcttttacttcagcagtttgcatatatcatacagctctctcctggtgatagaatttggatatttgtcccctccaaatctcatgttgaaatgtaatccccaatgttggatgtggggcctggtggaaggtatttggatcatggtggtatatttctcatgaatgacttagcaccatcctcatggtaatgaatgagctcttgccctgagttcatgtaagatctgattgtttaaaagactgtgacacctcccctgccctctcttgtttctgttctcaccatgtgatacaccagctcctccttagccttctgccatgattgtaaacttcctgaggccctcaccagaagcagatactgctgccatacttcctgtacagcttgcagaaccatgagccaagtaaacctcttttctttatatattacctagcctcaggtatttctttatagcaatgcaagaacagatttaacacagaaaatggtacctcccccacccttgctcctgctctcaccacataataccctggcttcccctttgccttctaccatgattgtaaactttctgaggccctcactagaagtagatgctgatgccgtgcttcctgtagagcctgcaaaaccatgagctaattaaattgcttgtctttataaattacggagtctcaagtgttcctttatagcaatgcaaaagtggactaacacacctagcctgtaacgtttctgcaaacaagtttgctgctaggtgtattggaacttccttatttgttctttgcttcttttcttttactgctttcaggattctctctgtttttgatttttgacaatttgattatatgtcatgaggtagtgttatttggattgaatctgattggaaacctttgactttcctgtacctggatgtacatctttctcaaggtttggacgtttttctgctatcatttctctaagctttctactcttctatctttcttctctccatcttaaaatccaatgaatcaaatatttgcttttacaatgctgttccataaatcccattgacattcttcattccttttaattctttttttctctcctttgactagatactcttaaataatctaagttcacatattatttcttcagcatgatcaattctgttgttgatgttctctattgcgtttttttcattgtatttttcagccccaggatttatctttgattctttaaaaattatttctatctctttgttaaatttcttattctggttactttacagtttttctcatttattttaattatttatctgtatttttttaatgtggctgagcttccttaaaatagttcttttgaattctttgccaggtagtttgtatatctctgtttttttatggccagtcactggcactttattttgtctccctaataatgtcttgtttctctgattgttcttgatctctgtggccatatgttgatatttgcatatttgaagaaatagttacttattccagtttttttaaattggctttgcctgggaatgcttttaaataataagcccttccggagactccagcaggccctctggcctggtccctaagcctggcatggctgtggccgttgtggtgctaggggagtgccctatgccagggaccactgtagtcggtgtagtactgtggctgagttgggggcagtgctggggtgcagcagaagccccatggttgctgaggcctgcttgccactgacatttatccagggcccacggccactgtagatatccagcagggacacacattgagttcactgcacaagggctatgctttcccatctggtgccagggcaggtctggaggcttagtccatagatacttcattcctctttcacttttttaaatcttatcagcctctgaaaaactagtatgcccattttaccacataactcatttgacttgaatttctactttatgaatttcaaattttttccaggctctcaaggttagaactattatatattgcttctattaatgcctatttgttgttattttctatgactcctcaacgtatttgctattgcagcaatctcctcagcacaacacatttcaaaattattcctcccattactcatgttattcttctcaccttatctgtttttgccatccttcaaggctagcatgtagctgagagagcaatacacatattgtcatatctgagttcctgtcccagctcttactaggtcttagtaattgtgcgactttgagtaagataaatgagataaagcagctagcatatttaccaacacatggaagacactaaatttttttctcccaccctcactccacagggttttttatgaagacttgcctgaatacactctctctcctctgaattgaaaatactccctaggtcacaaaaaccaatgccattttgcaatttttttttgtatttttaattgcaaactatattataaacatctttatgtgaattcttctacttgtacatccattattccctccacaaagcacctcttataacactgaggataccaagcactcaataactacttgttggttggtttgtctatatctcgaaatagaatagcagtgtcaaactttgttatatctattggtaaaatataattctaggaaaacaaacaattggagaacttggttcttattttttcatcttcttgtggtccttgttaatgtctgttggttcacaggtgatgatatacaaaatttaggaagaagaattttcgttctttgttagtggaagaaatttttgttattggaagtcatttttgaaaaccttttcattggttttaggattgtagggggaaatggaatcaaaactgcagtgatttagaatatcataggatagtagaaccaggaaattaacatatttaattatagattttgaatgacttcaaaggaaactcagttttttcaaggtattaagccaggaactgggccgttattataggaggccacttgggcttccatttagccagtttctggcacattcattgacaggaataatttaatgattgtgaataatcaccaagtgtaggaaataaggtcctctttgaatcataaagctttttttaaacatgaaaaatgttatgcatttttttgagaatggtgaaatatgcaaactaatttcatattgtcctaccaattatgaatgtgttattcctggcaggcaggtctctttaaaattgcatatgcttagttctttgccagggagaagagagaaaatcattgtcagcctctttatactcagctggggccaggtgttgttcattaacatgtaaatagtgcaattactgccaattaagattttttaaaacattaaaatctgtgggaacacagttatatcacctataaaatttaaaatacatgtatacatcttagtgctttagattcctacaaggcatgtactataacttgtagtcttaattacccaatgcttcaagttgtcatttatttgcacaatgccacatatgaggttcaaatgaaatgtaaaagtacattggctgagtttatgattgtagccaaatattgagaatttattatggattatattgattgtcagattattttgatttgtcctttaaaaaatttttctatttcttactccgtgtaaggaactgggttaagtgcaatgtattcaatggtgaatgaggcagacatggtctctgcccccatgaatcttacagtgtagttgggcttcacaaataaacaagcaatacacatacaaataagcatacaactaggtaagtattgttataggtactgttgtataaaatgagagggtgccattagaattcatgatggagcaggatgagtacagtttggatagagaggatagaaagctctctatgaatatgcagcatttccactgaagcttgagggataaacaggtgatatccaggtgaagagagtggagaagagcataccagcaagagataagagcgcttagaaaggccttgaagcaagaaacagcttgctgtcttcaagtaattgacagaaagaatacatgccaacttgaaggtagtggttgcctccagggagcaaaggagcagaacagaatttagaagcagtaagaagggggtttcaagagcaactgtaatactttaattctttaataaaaaatataagcaaatataatgaaaggttaacattcattattatcccttggtggatttatggatgtttgttatattactcttggtacttttctatgtgattaaaatgtttgatcactgggaaaaaatgtgaatgagaggtgagaaagtagattttaaaatttgtttacagtagtatgaactgggctttgttataagaaagagttaaaaactgttaatgtatttttgcctctttaaaaatatttctttgaattttacttgggggtattcaaacccttagccactactgatatctattagcaaactctattatctattgatgacatagatactactatgttatcaatagaaataacttggcaacaagcacatccttctgctgcaccctactttgcagtacaatagtttgtttttgcactaatagagctacttgaggctgaagcagtggggcttagaatgaaacctttattggggggtggggccaagatggccaactaaaaccagcagcaatcagaggctcccatcgaaaagaaccataacagcatgtggatcctgcaatggcaaccgaggtatccaggttctgtcatcagaactgactaggcggctggtgtgacccacagagaggaaagaagaacagtgtggtgtggtggcccatgtgggagccatatggggcaagggagcccccagccccccagccaagggaggcagttggtgccccccaaggtcagagatcccagaggaaggagcaggcacccatctttgctgttctccagcctcctcgagtgacatctccaggtacgggagtgaaccagatgaatagggcctgaaatgaacccccagcaaactgcggcagccctaaagaagagggacctgaccattgaaagaaaaacaaacagaaagcaacaacaagagcaccaaaaaaagtccccacaaaaaccctatagaagggccagcagcctcaaagatggatactagacaaactcatgaagatgagaaagaatcaacaacaaaaaaaagttgaaaacccaaaaggccagagtgcctcttctccaaatgctcacaatgcctatccagcaaggggacagaactggaaggaggatgagatgggcaaattgacagaagtaggcttcagaaggtcagtaataacaaactccactgagctaaaggagcatgttctaacccaatgcaaagaagctaagaaccttgatgttaagggaagccagagaagaaggtcaggtcaccttcaaagagaagcctatcagactaacaatgaacctctcagcagaaaccatacaagccagaagagagtgggggccaatatgcagcattcttaaagaaaagaattttcaacccagaatttcatatccagccagactaaccttaataagtggaggagaaataaaatcctctccagaaaagcaaatactgagggattttgtcaccaccaggcctgccttgcaagagctcctgaaggaagtattaaatatgaaaaggaaaaactggtaccagcaactgcaaaaacacaccaaaatataaaggccaatgacacgatgaagaaactgcatcaactagtgtgcaaaataaccagaaagcatcatgatgacagaatcaaattcacacataacaatattaaccttaaatgtaaatgggctaaatgccccaattaaaagacacagactggcaaattggataaagagtcaagacccatcagtgtgctgtattcaggagacccatcttacatgcaaagacacacatagactcaaaataaagggatggaggaagatttggaaatggaaagcaaaaaagagcagggattgcaatcctagtctctgacaagacagactttaaaccaacaaagatcaaaaaacacaaagaagggcattacgtaatggaaaagggatcaattcaacaacaagagctaactatcttaaatgtatatacacccaatacaccaagattcataaaacaagttcttagagacctacaaagagacttagactcccacacaataataatgggaaaatttaacaccccactgtcaatattatacagatcaatgagacataaaattaacaaggatattctggacttgaactcaactctggatcaagtggacctaatagacatctacagaactctccaccccaaatcaacagaatatatattcttctcagtgctacatggcacttattccaaaatcaaccacataattagaagtaaaacactcctcagcaactgcaaaagaactgaaatcataacagtctctcagacaacagcacaatcaaattagaactcaggattaagaaactcactgaaaaccacacaactacgtggaaattgaacaatgtgctcctgaatgactactgggtaaataatgaaattaaggcaaaaatcaagaagttctgtgaaacctattagaacaaagagacaatgtactagaatccctgggacacagctaaagcagtgttaagagggaaatttatagcactaaatgcccacataagaaagaaagaaaaatctcaagttgacaccctgacatcacaattaaaagagccacagaagcaagaggaaacaaatccaaaaactaccaacagacaggaaataatgaagatcagagcagaactgaagaagatagaggcatgaaaaatccttcaaagaaaattaataaatccaggagctgtttttttgaaaaaattaacaaaatagatggaccactaactagactaataaagaagaaaagagagaagaatcaaatagacacaataaaaaatgataaaggggatatcaccacagaccccacagaaatgaaaactatcataatactataaacagctccatgcaaataagctagaaaatttataagaaatgaataaattcctgaacacatacaccatcccaagactaaaccaggaagaagttgaatccctgaatagactaataaaaagttctgaaattgaagcagtaattagtagcctaccaaccacaaaaagcccaggaccagacagatttacagccaaattgaaccagagatacaaagaggagctagtaccattccttctgaaactatttcaagtaattgaaaaggagggactccaccctaactcattttatgaggccagcatcatcctgataccaaaacctggtaaagacacaacaaaaaaagaaaacttcagaccaatatcactgatgaacatggatgcaaaaaatttcaataaaataccagcaaactgaatccagcaggacatcaaaatgcttatctagcatgataaaattggtttcatccctgggatgcaaggctggttcaacacatgtaaatcaacaaatgtaattcatcacataaacagaagcaatgacaaaaaccacacaatcatctcaatagatgcagaaaaagcctttggtaaaattcaacatcccttcacgttaaaaactcacaataaactagatatcaatggaacatatctcaaaattataagagctacttatgacaaacccacagccaatatcatactgaatgggaaaagctggaagcattccctttgaaaactgacacaagacaagaatgccctctctcaccactcctattcaacatagtattgtaagttctggcagggtaatcaggcaaaagaaagaaataaaggatatttaaataggaagagaggaagttaaattgtctctgtttgcagacagtgtgatcctatatttagaaaaccccattgtctcagccccaaaacaagcagagagtcaaatcatgaataaactcccattcacaattgctacaaagagaataaaatacctaggaatacagctagctaggaatgtgaaggacctcttcaaggagaaccacagaccactactcaaggaaataagagaggacacaaacaagtggaaaaatattccatgctcatggatagaaagaatcaatatcatgaaaatggccatactgcccaaagtaatttagagattcagtgctattcccattaaactaccattgacattcttcacagaattagaaaaaaaaactactttaaatttcatatggaacaaaaaaagagcccatatagccaagacaatcctaagcaaaaagaataaagctgggggcatcatgctacctgactttaaactatactacaaagctacagtaaccaaaacagcatggtactggtaccaaaacagatatatagaccagtgaaagagaacagagacctgagaaataagaccacatatatgcaacaatctgatctttgacaaacctgaaaaagaaaaagcaatggggtaaggattccctatttaataaatggtgttgggaaaactagctagccatacacagaaaactgaaactggaccccttccttataccttatacaaaaattaattcaaagtggattaaagacttaaatgtaaaatctaaaaccataaaaactctagaagaaaacctaggcaataccattcaggatacaggcatgggcaaagacttcatgactaaaacaccaaaagcaattgcaacaaaaacccaaattgacaaatgggatctaattaaactgaagaacttctgcacagcaaaagaaactatcattagagtgaacaggcaacctacagaataggagaatatttttgcaatctacccatctgacaaagggttaatatccagaatctacaaggaacataaagaaatttataagaaaaaaaacaaccccatcaaaaagagggtgaaggatatgaacagacacttctcaaaagaagacatttatgcagccaacaaacatatgaaaaaaagctcatcatcactggtcattagagaaatgcaaatcaaaaccacaaagagataccatctcacaccagtagaatggcgatcattaaaaagtcaggaaacaacagatgctggagaggatatggagaaataggaatgcttgtacactgttggtgggagtgttaattagttcaaccattgtggaatacagggtggcaattcctcaaggatctagtaccagaaataccatttgacccagcaatcccattatgggttatatactacaaggattataaatcattctactataaagacacatgcacatgtatgtttcttgcagcactgttcacaatagcaaagacttggaaccaagccaaatgcccattgatgatagactggataaagaaaatgtggcacatatatggaatactatgcagctgtaaaaaggaatgagatcatgtcctttgcagggacatggatgaaactggaagccatcatcctcagcaaactaacacaggaacagaaaaccaaacactgcatgttctcactcataagtgggggttgaacaatgagaccacatggacacagggagggaaacaacacacacctgggccagttggagggtggggacaaagggagggagagcattaggacaatatctaatgcatgcttggcttaaaacctaagtgacaggttgataggtgcagaaaaccaccaaggcacacatatacctatgtaacaaacctgcacattctgtatttgtatcccagaagttaaagtaaaattaaaaaaaaaaaaaacctttacggctaactttatcaagtaaccaaatccctttattaagaacaactaataagcccatccttcatcaaagactcttattacctagctaactctgttataatgttaacactttaattatgtttccagggaaaaataagtcatgccactgtctctgaaaaatgcaaccaagttaataggggcctttgaaaggaagttcttgaattccagtattttaatccttcagcctcatcatagtaattttatatctggatggacaagtctctaggaatacctagtgactaaaaagccagtggaagaaggtatcctaaaatccatcttgggcagccccaaggaactatgtgctatggaaaacccctcaaagaataatcaactgcaggttgcccttgtttatctacttgcctgattgaagagagaaagccagacccatccagttcagtcacatcagcacgaacttcagttcaacagacatttgactcattactatatacagggcacttcatgggctacaaaattgagtaagctacaacccaaaaatgccaggagtttaaagtctacttttggacacggaacaaatacaaatctaatccatttcagagttggaagaagcgtggaagtgagctcatggtgaagtggctagggaaagagaaatgactatatctctttcaactcctagataaattgattcaaattagactgatgttccttattcctaaccatgacattctcatgaaagagaagctagtagaaatctagaaatactcattgtaatcaaatggttgctttaaacaccaaggtaaaattcagttatatataattatcattcacaatctaggaaaatgtctctttttttcataaagaggccaattataacaataaatgtcaaattccttaagtgtaaatcttatagttgaggcttaagtaactaagactgtatctggcattccagaaaagataggttgatattttatataaaattattattctgcctgatataccatatcttctatatttagtataataatgagctcttcccagcagagaacaatatttttaaaatctgatgtttgatgccagtcccaagatagtcgtactcaaggtacttgatttagaaagaagaaaacagcaagattttcctgtgtttttaagtcgagaagtcccgattttataaattgacttggatagagaagtacataaaatataatgcaaaggtcataagggtctgttatctgttccaaaatagtgatccctggtggaaaagcaatgtagtgcatatggccatggctgcaaaatgaaaatgtgttctaagcaggacctgctgaactgaataagcacagatgtacttcaaattaatatttaatctgataccaaatcacttaaaggagttagggatatgaattcctcataagaaataacttccttctcacagagaacaattatggtactgcaaaggtaacacaaataagattgtcatattttcgttagatttaaagagtaaatctggaaatgaaagtattttgctggctctttttttgaattttcttaatattatttcttgtaaaaagaaaatcctctttgaatgtgatggcatggatcaaaatgaaagctaataaagtcagtttgattgagagactatctcagcccttgagagtagatgagagtgatttttaattgacatcattagagtattattagaataaaatagaaccaagtaaaatagaaccaagtaacccttactaatctttaaaaggaaagtgcctataatcaagttacaattctgaaaagcaattctgttgctttttcaggccattttcagaagcagatcctcaaaataagctggagtccagagctgtctcatgcctttcattttaaacccacttttgttccacattttggcctgtcaaaaatgttattatcacattacatactgaatactcagaaaccaccgcctaaatttaaaaaaaaaaagaaactgccaccttaggttaaagtgacatttcatctcttagggtggtttttttctgaattaaaagaggtgactgaacttactacttcaatagaaagcaaagacacttcacaagtatagtaggcactaactggaacatagtatgacaaagaaaaacaggctatattacacttaccatcatatttaccactaaaatattagctctctttgcaagatagttagcttttgtatgatcaaaatgccacatggacattgtattgaggtaactatttttagataatgggttagtcttatacattgcagcaattatgcaggaattataagctatctacatcttttcatttgaggagataaaggacatcccctcccagtcatgcattcaacaagtattgaaactacttcttatttatgtattcagaatatatttgagcacctacaacatgctaggcttgaagtattgaaactactaggcttcaagtattgaaactactacttatttatgtattcagtatatatttgagcacttaacaacatgctaggcactgtgccagatgctagagatgtaacattgaacaatgctgccctatatcccagtgggagaaagaagcaaaaagtcaaaacagaaatatgtagatatggtaataccattcatttcagagaataagggaggtgattgtggaaactacgttaacagtagggaaagctgaaaaaaatccttccttaggaggtgacaattgaggtgggacctgaagtatgagaagagaaaatcaatcattcaatggatggtgagggcaggaagaccctttccggcatatgcaaagggcctgtggtggaagaagatgaccccatctaagaaatgcaaccagacccgtgtgtcaaaaatgtgatagactaaggggagaatagctcaacagaggaaactctaagctaaacagcaaccaggtcacagaaggtcttggaggccattacaatgagcttaaatgctttcctaagtacaataggaagccactgaaggagtttaagcaaggggtgggatgttcagttttgtttttttaaagtttattctagggctgactattgtacagtaaataggttggcggggggattggaagtggggaaaccaggaagctgactattgtacttattcagatgagagatgacggtggaaacagagagaggtggatagagagaagatatatttctgaaggaaaccaatagaatgtggtgacgtattgcatgtggaagttaaggcacaaggagaaatcggtatgattctattatcttgtttgagcaactgagtaccttgtggtgtcacttaggctagatgagcaaaagggcatagtgaaaataggggaatcaagaattatgttttaggtatgttaaatacttgtctatgagatatccaaactgttattgaattttggctggatacacaaacctaggcttgaggagcacatagttagcctgctactgactgggaggagtcagcaaacagcgacatttagagtcattacagttctttttagttcccgaatgcttattcctttggattcaggcattgatggctctactcaaaatatcagcactatctcaatggtggttccacatattagacattgtttcctgagactgacccgagacaatgtgccagagggtgaatgagttccgttgggatacagaaggtttttatttaaaaggtctggattatgcagttctattaagaaggcagatttgggtgggatttcacagtccagagggcaaggggccacttgggagaagaggaggaagatagaaagggaaagaggtttttaaaaagagatggaaatagtgctgtaaaagaaactgagtcatttcacaactttggagagagccgggtctgctactagatatttttctgtaaatttttgagttcctttttattaataaaaatgaaaaatttagtaagcacttactgtatgccaagcactgatctaagtacattacataactaactcatgtagttctctgcagaaagctatgaaatatgcgtttggccacttttgcagatgaagaagaagacacagagaagttccgtaatttctaaattcaccaaggcatttggtggtgtgctaagatttgaatcttggcagtcagtttccagaacccatggtcttaaccattacactatatatttcagtttcagtataatataacatgtgattgtaaatgtcttttttgtctttctaataagcaggtcttttaccaagactaccagagaaatcttagttttcattattttttgtcctgtaagttctacatgttttatggcctggagaataattatgatgatggttgtataatattaagatacctgcttccagtctacatattctgtgattttgttctattttatttcatttttattttctcatatttcttagccctttgccccttaaaaataattaccagagtagtatttactgatcatcatagaaaccactacccaattcttcaaccctattatattgatcataatttattgatgaggtctgacatctcacactctttatccagacttcctcccatgaggaaaagactataaaattattttcctgcctggcacatttaattccagaaacttgcatctaatactattgtggtgaacaactccagctgctgttccaggttcagagtcattttactccatagaaaaaaagtatgttaattgactaatctatatattgtaatatttgtttctttaatgatagggttttaatttaacttagccatatgttagggcccatgtttagaaattagtctattttcaaactaacattcaagaactgcccaagtatacagagaagtttaattgactgaaatgtgtaaaacaaagcaaaattattaagttaaaaataatgatattgtctagttattttttaacttcgaaatacttaaaactccttgaaactttgctgtaatcaactgatttttaatttactaatttgaaagtgttttgctttattaaaatgttttttttcatcctagggatactttttttctcatggctaggtttcatctgtcattgtgccttatgggcttgccctttgccttttgcaaatggtctatttcccttctaacaaatatgcttcgaattttcataaaagatatgtaacaatgttagctttttttctgggtgagaaatggcataacacaactctaaagagtttattactgtcaaagtctgtcccttggaattataggtagatgtttgtgaaaagaactagaaaattctctctcttcttataatcttcaagaatacttcggatgaatgtgagttcagaaatggtcattcctgtgacattggcatgtttaaggcactgaccaactgataggcacaatctaaaaacaaaacgacctatgcctactggaaatctgtgtaggctgtatagactctggaaatttcactacagaacacctagcacatgatttttattcagcatttggtaggaaaagaaaatgaatttatttttcaaataaaaaatgtatcaaggaaagttctggggaaaggaaggagtatgggattgggggtagaagtggaaatttgattacttgagttattgaaatgattcagaatggcaaacttctagaagtactcccaatttccctctgagataattcagtcctcccaaagataggtcgggtgtttcccagagagaggaaatattgtactatctgaaagaaataaaatccttccctggatccatccttcataggaaggttaacatctccctgaaggctttctgtcaactctggagacacagtgtggtgtgtctggggagcatattttacacacatgcacacacacacacacgcaattatgcacacacaagccattaaataagacagtgaaataataactctacttattgccagcttcctactgaagtatgcctatcccattgctcccataatggagaaaattaatatatcctgtcagggtcacataatatgaatagtgaaattctgtgaagtgactgcatgtagaagagtcaggaaatccactttgatctacatttttgatgtttgataattgcacttattatcaggtcctttctgctctttttctttgacatgagatccattatcagtgacagcatgagcgtgagtatgtgtttgatttaaaaaactacttaagatgaggtaatggaaaagaagcgttttttgtccatgcatattaaaagaatgggagacaattaaatctcattatacagtggctggcttgaattgtttatcttttatgtatggcattgtttgggcacctcatggggtaacttttttcaaaagaaattatttcctagtgatatattttgtatatatgtagactgttatcatttgctttgatgctttcattctatgagaaagcattgagagaagagataaagaaatgatggtcacaaaaaataggacaggtcatgtagccaaccgctgctttttcagaaatcgttataaatagaatgcatagtcatatgtgaataggactaaaaacagaacataaattcatatttataccaaggcagataattggtaaatttattaactaggattctttctgtatctgttaatttattttaaataacacaagttaccttgatgcaagtaattattggcaattaatatgtgataaggtatttgaacttttctgcttgcctaaattttacaacaagggctcaggctaatttagcactttaacgtgtcaccttgcacattaacaaattagtattcttcacagtagaagcctaagtaaaatgctaacccattcatttactattttttttatttctattgtggacattacctacttttggtctttggctgtcaatattatacatataaataagtattctataaatcagtattatataaataatacatggctaaatggtaaaattataaaactctttcagccaaaattaaatgctactcccatatttttgcttacaaatttctcttctttgctgaataatagagaaaaataaacttgtctttactcatccaagttaacttggatttaatttggagcagctaaaaaaattaatagtctttgatgttcctcttttccattaactttacttttttcagatatgttctcaataaaaagttattggagaagtagtactcctcacggctcttggagaaaatgagagtgtatttggaaatagtttatggagtagcttttgtagcctctgactttctctgagtgacttcgtacccaaaaacagtcaggtggaaccattttgtaaagtataaagcgccatacaaatgtcatcaaatgttagaaaaagtaggagaatatggtaagatatgacaaagtacaaccacatacattccaaatgaaagccttagcctaatttgagctacatttgtgctacctttgaattgctagtttatttgttagtgcttaatatggtttgactctgtgtccccacccaaatctcatagctcccataattcccatgtgttgtgggaggaacctggtgggagatgactgaattatgggggcaggtctttcctgtgctgttctcatgatagtgcatgggtctcatgagatctgatggttttaaaaaggggagttgccctgcacaagctctctttttgcctactgccatccatgtaagatgtgacttgctcctccttgccttctgctatgattataaggccttctcagccatgtggaactgtaagtccaataaaccactttgttttgtaaattgcccagtcttgggtatgactttatcagcagcatgaaaatggactaatacagtaaattggtaccagtagaatgaggcgctactgaaaaaaatacctaaaaatgtggaagcgactttggaactgagtaacaggcagaggttggaacagtttggagggatccaaagaagaaaggaaaatgtgggaaagtttggaactccctagagacttgttgactggctttccccaaaatgctaataatgatatggacaatgaaatccaggctgaggtggtctcagatggagatgaggaatttggtgggaactggatctaagatgactctcgttatgttttagcaaagagactggcagcattttgcccctgccctagagatctgtggaactttgaacttgagagagatgacttagggtatctggtggatgaaatttctaagcagcaagagtgacttggtgctgttaaaggcattcagtttttaaaaggaaacagagcatgaaagttcagaaaatttgcagcctgacaatgcaatagaaaagaaaatcccattttctgaggagaaattcaagctggctgcagaaatttgcataagtaatgaggagacaaatgttaatccccaagacaatggagaaaatgtctccagggcatgtcagaggtcttcacagcagcccctcccatcacaggctgggaggtctaggaggaaaatatggtttcctgggccaggtccaggacccccctgctgtgtgcagcctaggaacttggtgccctgcatcccagccactgcagccatgactaaaaggggccaaggtacaactcgggctgtggattcagaaggtgcaatccccaagtcttggcagcttacacatggtattgaccctgcaagtgcagagaagtcaagaattgaggtttgggaacctccacctagatttcagaagatgtatggaaatgcctggatatccaggtagaagcttgctataggggagaggccctcatggagaacctctgctagggcagtgtggaagggaaatgtgggacaaagccccaacccagagtccctgctggggcaccaccaagtggagctgtaaggaaagggccactgtcctccataccccagaattgtagatccactgacagcttgtatcatgcacctggaaaagccacagacatgcaacacaagcccatgaaagcagccatgaggggggctataccctgtagagccacagaggcggagctgcccaagactatggaagcccacctcttatatcagtgtgacttggacatgagacatggagtcaaaggagatcattttggagcattaagatttgactgctttgctggatttcaaacttgcatggggcctgtagcccctttgttttggccagtttctcccatttggaatagctgtatttacccaatgcctgtatccccattgtatctacaaattaactaactggattttgattttacaggctcataggaggaagggacttgcctcatcttagatgagactttggactgtggacttttgagttaatgtcgaaatgcgttgagactttaggggactgttgggaaggcatgattggttttgaaatgtgaaaatacgagatttgggagaggccaggtacagaatggtatggtttggctctgtgtccccacccaaatctcatattgtagctcccataatttccgtgtgttataggaggggaccagtgggagatgattgaattatggggatgggtctttcctgctagtttatgttagtgcttgatatggtttggctctgtgttctacccaaatctcatcatatagctctcataattcccacgtgttgtgggaaggacctggggggagattattgaattataggggcaggtcttttctgggctgctgtcatgatagtgaatgggtctcatgagatctaatggtttttaaaacgggagttgccccgcacaagctccctttttgcctgctgccatccacataagatgtgacttgctcctccttgccttccaccatgattttgaggcctccccagccatgtggaactgtaagtccaataagccgctttcttttgtaaattgtccagtctcaggtatgtctttatcagcagtgtgaaaacagactaatacagtgctgaagcacatatactatattatagaatctatctcatttcattgttctctagcattcttaagcattgtaaataatttagcacacctttagggaactggaggagttaaaatatttttattggaaatttgtaaagataatattaagagcttatattttagtctaatcttagaaaataatagaaaagcttacaccattgtcagaatacctttctccccaaacaggcaaatttcaatgctgttatctgaatatgctctctagggacaagagataacctgttgagaatttgtgactttccaacatctttttgatggaggtggattctgataccataagcaatggatatcacctacatcaagagtattgctaaaggcagggcctgaaatcaaaggattaaagaaaaaggaaaggggcccaaatcaaacttatttcaaattctgtgtatagccagtaacatccaggcaagatttacaagagggtaaactttcccaaagtttgtaaaatcatttaagtgagttaattccatatggtgaaagtatacacaaaatgtgtctggagatacattgttattaataatacactttccagatattttcacagaatattaacttcaatgactgagcagtactatagctgatgacctcaaatcagttccaattaatatgcctctgcttttgtacataaaaggttaaaaattagcactgtaatgaaatgttgcataatactttgagagttgtgttgagtgggcaataatattttttatttaaatgataaaacagggtattgaatgaaattactaatgtttccatgaatactgaaagtataagactcccgtgagtacagaactgttaacctcttttgaattgagattttgatgtcatatatttatattgagttacattattttttaaagaatagtacatatttttattattacatattaaagaatgagtacatatttttactgagttgttaggtcatgttcattcctttgctttgtctttctggcttgctttttgccttatcatggataggaaggggaagggtaagcattcagaaattactagctttgtccatataaacagttgctcagtaaaaaactaacaaattgttgaaccataataatattgttttccatattaaaactcaggcatgggaacagcaagactccattggtttttcaaacctgctttgtgacaattgcatatatatggttctattaagccctttcacttggatacagtttatttccagaaatgttcaatttgtggatagtgttcatttaagaatttcatcagtgtttgaaaaaataatttaaatgttgactgatggaccactaaatcctttgaagttgaccacgcagtcctcctgcatgccagaaacctaaattcgtgtgagtaggtgttagagggagtagtctatatgaaagggagactctttgttttgtgaaacgatttactacaagtttattttaaatcatgtagtcaaaatataatttaacagagcaccagttatttatataataatacatttgccagatcacatatgatggatatgcaagagatatatctgaaaactgaatggcagaagcaaatacctatttattcgtgtcttcctgtacaaatatcaactgcttcccaatttgaaaaagcatggttaagatagagaatatagtgcagtattatcttcctgcttccaaataagataatatcatagtgaatatatattatgctttatagttaacattcttacgatgtatattttctagctttacttggaaattctccaaaaaattgtatatatgtagattattgttatattcaggagcaacattgacctattatactaatagtaaatacatgggccctatataaacgctacttgaggcaaatgtattcaccatatgaagctactataagatgctccaaatattcatggattattcaaaattagagtaaacactattgagcaaagtacaatatttgtgaataatttgaaatgtcaccattttgaatatttattacacagcatgacaagatagaatcattgtccaggagactggctgacaaatcgggtctcatgaggaagtattatcctttccattatctgttacttcaagtccattctgtttagcacttgttacagcatctaaagtgatttgacctctaaggtctgccttaccttaaccaaattgagactgatgtataaaaccagtcagtcaactgattcatttacaatataaaatataacttcaaagcaagtcaaaatattcttgtcagtggtcaaagtatttggtcaaagtattgtttcctgttgggaagctacatgggaaaccaaatgataaccagaaggttcctttacaaggatggatatgagagaaaaaagaagttagttggaagaccaaactctgagtagtccattatgggatatgcctggcccagcatcagatacttagattcctgaataaggtgacccgtttaactagacagcatgggtaaggataacaatgataaattctttctatgattctccttttctatgtcccatgtttctaatagcacattctttcttcccactactgtaactattaccatatcagcttaatcacatctggctgttcctaaaatacttgaccactcagttacagattattacttagaatgggctccttctacaactaatctcattcattacattttattcctaattttattctcaattaatggtctttacttttaaatttgggaggactttcatgtccatattgcctacaatagcctcaaaccattgctgtatccaacgcttcctcaataggtgactagccaaagaatagaaatatacattgccatgtaattgagattcttttgatggtatataacagaaatgtaaacaaaaaagtgagaaattcaatttattattagaatataggagtatctcagaacccaaggacagaaatcactataaggcctaattgagggactggactaggaattggaaagaaatcagtaactcccacaccctcaattttttcatgtattcctcttgtgtgtttgttttattctctctgcagatgaactctccttccctctgtatgtgaccagaaagggccatacttctgatcatgaatggacataatatctcaaattttaaaacctgactaactaatattctgtcccaactttaaaatcccaggagagatcatcttattagtaaaacttggatcaggggccagctgccagagtatttgactctcagaatattagaggaagaatcatataactgccacaggagccttatctctgtggatagtgggcagttttcagagaaagggaaggtgagctaagcaaatatctaaaaattggctgctgtatatgaagagactaatgagacttaggcatgatcatgaatgacttgtctttcctcactttttatttcaaatactgtgatttttcaccttagaatttccattctcttttttgttttctatttctctgatgagatttcctttctttctgtttactgtgggcctattttccttcatatcctgagcacagttatagtatctactttaaaaccctggtctgctaattccaatatctggttttcttggagttattctctataggttgtcttttctcttgagaatgagtcacatttttctgtttttcatattttaaataattttggactgtattttggacattgtgattgttattttgtggagactgtagattctgttctattattattctaaatagttttaatttttttctcttcatgtagaaggcaattaaattttttggactccaatgacaaattctgtttcttgagctgcagctcaaatctcagttgagtttcttcattctcagttgcagtcagcctcacacatgcatgattccaggtcagggagagatttgggcagagtttatatacagaatatggggtgcattctctctcttatcttttttgggggatgcccccttgactttccagtggttgtggttgcctaaactctgttccctatttttttatgtgagagatactgagagttttctgtcaagatttctgccaccctgtgctgcctcattgtttcctaccttctggtttaaaaaaataaaaaataaataaataaaaactggaaattaacccatgccttcccttcttccaagtgttgattccccaccataatctgcttcttttgttcactctccagttcctaaaggtcatcgatttttttattgaattttgtctagtgattatcacctgcagaaagatagattatgatagaagcttactaaactatacccttctcaccacttattcgacattacttcctgctctttatagtgagttctttttaaaaattattataacacatgcttatcataaaaataacgagtatgtgtataacacaatatatgctagattgttctaagcaatttttatataataactagatcatgaaataaatagtacagaattatgtaatgtacacttaaaagttctatttctcccactattctactctgagagatgagtattcttcctgatatttcttacacaagtcaaactttactatatatcatctttctgcaatatgcttttctcacactcacaatatatcataggtatctttccaaatcatcttaaatcttaaattatctaacataaatttgctactactagtacaactttcacacacatacacaaacttgcagactgagtacactcatatcatagagaaatttgcattatcatttttatgaacgaacttttctggttaggtagctttacccaactaattttcttttccttctccttcaggtggctaaaccataaccatgcccaatgtcagaatattgtcagactgcactctacaattaactgtttttccttatttaagtcaagtcaattaaatccatacaatcattgtgaaactaaaaatgaaataatgtatatgaaaaatacttcaaaaagtttaaactgttaaataaatgagtaatatcagtttgacctacattttttagtatctgctgtgtataagagtctcggaggttataaggatgaataggatgcaatatcggtcttcaaggtgatgacaatctagcttttaaaatgtagttaatgctatgacatagatttttttaaatgtgttatgggagtggcaatgggaggacaattgattctgacaaagagaatcagagatgtatgagagatgatgaggtgaattggtccatgaatgataaaaagaaatttcaggtatgagactgaaggaaggggatgtattccaagatgaaagaacagtgtatatgtaggcatgaaagtatttatttttctggtaataccaagtaagtcattttggttgaagcatagggtatggtatatatggtcatgggaggggggtaagagtcaaggattaaaagtagaatgagactatagagtgagtcacatttggatttataagggccttataggtgttgttccaagaaatttgcctacaatatgatagccagtgaattaaggatcttgcccagagaaatagcacagtgtatggtgtataagacaatgctagcttctgttacaaactaacctaaaattgtacaatggctcaaaaatagtagtttgtttctcattcacctaaaatgcaactggagaattcctgattagtaggctgttctcctgggcttgacttagggcacaggctctttccatccttgtagcgccactgtctttaacacatggcttgaaaagttgccatgtttgtctacatcaagctagaggaaaggaggagagcaaagatcatgagtggaagattttattgaccagacctggaaatggtactcaacacttctattttctaaactcagtcatatgtatacagttatctgcaagaaagcctgggaaatgaggtctaacttcttccttggaagaagaggagaggaatgtagtgaacaacttggtggtctctgtcacaaatagtcagatttagtttttagaaagcccaccctggttgcagtgtcagtgatggattgtaggaggagatactaaaagcaggagagcagataagaggctgttttcatagtgcaagtgagagatagtcaggtcctaaaggcaatgcttaaggagccacttgcatcagggataagacagggatacattttggagaccagatttgatgactgagaattcaggggccagagtttgttgacttgagcaataggttgatagcctagatgaatggtgattactctatatcatgataataatgctcatccaaaaaaaatgattgcttacttagactggtaataattgagtgtttgatagatcagagccctttgtcaagagctataggaaaataaagtagagtattttatatggccctttccctcaaggagtttttaatctatctgaggagagagaatacacccaaatgacaacttgacaacttttatgtatatcagtaaatgtgagttaattcaacacaaactgaatccgagtgctagaggggttggtggaagagttgtgtttaagaatgcatgggatcattaggatgtaagtttggaagttggattttattctttcatttaacaaacatgtattaagtgtatggtgtgcttagataactgtactgctggttcataaaaaggctcaagtaatatttgttgaataaaatattagttatttaatgagacaaacaaaaaataacccttacttttgagggatttattagaaataagtaatatgggacagtaaggttaacataaaggtaaacaaccagtacaataatgtttaacaagtggtatgatagaatggtccggttggggcacaaaggaaggaatgttcaagaaaaatctttgttaagcatgaaactcttgagcttgtcttggaataacagtacaagtgaccacacaaactaaagatgaaagagagagaagaaaggtctttccaatgcagcagcaaagatgaaggtatgacaaggaaagtgggttggcaagagatgaagcctagtgttccctgaacctagtgttccctgaatttagggaccaagtcgtgttaatatctgtacccttgtgcatagtacttgtcccttttgagatgctcagaaaataatggattctattcctatatgccttcttgtagtcctggcgagtgtatctagtacacttctcttcaacttcagacatctaactaattaacagaggtagtgaaataatgatttttccatcagtgactgaaggctctgcttgtccctgctggtgacctcactttacattctcctgaggctacaaagtcatttgcaggtatatttggttgttttaaatcacagttgcaaaccatcactgatataagccatctaaagtcccaatttctgctcaaagagagatgcctaactgaaataatagtatcaccaaacaccatcttgaattcaaaatcagattgaggcaacaaataaagttttatgtgatgtgaatcaccaatggtatgaatttctcttactctagcagaactatatttcttaaaagctaacaaccatattttcttagtgaaatttactgtttgaagtgtataagcacgctttggtccttgaagggttgtaattttaaccggagatatttcagaataagataataagttgagaaatgagtgcttgggcaaggagtttgaaaatgcaattttatttcattggcatttttctgtctagcctcatatgtgtttttatgcactaaataagtatattgtaatttagaccttgtggtttaattttccatgagcctaatccctaatctatactgggaagaatgatcctcttaaaatggggggtatctaaaacctcttttgtgttttcctgctaataaataacttatattaaaataaaagtatgggattgtgaatatttgaggtcagacagacttaaggttagttcccaatttgccacttactaactgggtggccttaagcaagttacttaaatgttctgagccttgctttcttcatctgtaaaatgagaatagtatcaactaccccttgcaggatatttgtgagaattagagattatatggtgggaattaccatgtatgaggtgtttaaagagtgggaattgctactgccacaaatattgttgttggcatctttcagttagagtcaacttccaggggaaaaagtgtatttggaactgccctctgcatataacagttttaaaacttttcccatttgcacaaagatcctatatgtgacctcaaagtatataatgggtaaaagtaaaggtgagatactcaaagcttcaggccccatcctagtccctaagacgtgctcatgaaatacaatttgaaaaccattccctcagtggcatacgtttacaagtgctaggggaacttaaaacatgacattaaaagaaaagcaagatttctaagaaagcactgcatagttcctggtagatccttgtatgatctaaatgcttattctattaaatgtatggtaaaaagcactgcaatcgggacttataagaaaatcgtgcactatgcctactgaactacccctctgtaaagaagcatgagaaatgaatcgtctttgaggagggcagtataaacttttcatgatttcctaacttttctgcagtattgtcaaagaggtaggctataacctatgcccacaattattgaatgacagccttccctcaagacactttactgccatcagaaacttactgtaaaatactagttgttagaataagactctctacagctatattccagaaaccttttaataagtctgttgattttcattatcctctacgatccctagtatctccaatgtgaatggcacactctgaaatggagcactcttgtacagtgtgtaatcagcatacattataccatgaccctgctgatatccatattttttaataaagatgaattgtttggttaaatataaatggcagctaattaaaaatataattttcacttaaatttttatacagatgcttcagaaatcaagttcaaataaagcagtaaaccatacagattctacaatttcaagggcttctctgtaggcagataaaatagcagaaattcagctgtcaacaaaattataggcagattaggtgctatctacgaattaaaatgtaaaatttgtaaataatcttccttgaggtgattgagttgcatatgatttactcacattgacagatgaaattccttcttttactttttatggcttaaaatatactagaaatataaatgcattcccttgactattaagctgacatacctttagaatattgaaaaaccaaagcaacattattttatttcagtcctcaaaagcaaatttttgcactaaaattccactcattgtgttgtagagctttgctccttagttcagctaaaacccagattcttgtcacatgaccaggaaagtttaggcatgcggacacattgaagggtgaggggagcaggactttactgagcgaaaaggataaaaaggaagaaaactcagcaaagtgagatggagtcctgctaacaagccctctgcctcacagattgaatcccaggtcaccacataaaaactgaggagtccaggctcctcccacctgcaaacaacgcaaacttcccggggctccacctcgtcctcccagtgcgcaggccagttgcagattctccagggaccccgttttatctgcctaggcatttaactgtccctactggaacaaaagtagtttgcaatttaagagaacaattaaatatcctggtagtgaactctgtttcctgaaacgaatccactggataatgaaaaccaagacagtacaagaggggtcagcaaactatggcctgtgggccaaatctggcctatcgactgtttttgaaaatcaagttttattggaaaatagctgtgttcattcatttacacattgtctgtggctgctttggtgctaaactggtagagttgaatactagccacagagactatatgacctgcaaagcctaaagtatttactgtccagtccttcacagaaaaggtttgctgacctttgcaatattaaattatttgaaatggcaaataaaatattatatatgtttgtgtgagcaaatttatcaatacaaggaaggatattccacactttaaatgttaattatcatcaggaaaggtattggcaattaaatagaatacttctttcttccttgttgcacaattctactgcacctaaactcttccagtcactgcacatcaaaatacataaaatggaattgaataaaattcagagaatgaaaaatgaatttatactagactgaataatggaagagactcttacatttggggaaaatgatgagtggtgactttaccaattcttcaaagtcaaaaaggccaatggtaagctgagtactaacttttcagtagaacccttgaatacttgacaaagtactccaaagacaaaactcagggctataaggaccataagtgaaacaacagtttgtcagaagggactcattccttcctgttaagtttatataactacattgaatacaatcagaattcagacataggattactaagtggcgtttttttcaaaaaaggaatactaacactgatctcaagctaacagaaggtggcattgtgaccttcagaggttaagagcagtaagcagaaagttagtattagtatacaggagttttatttaattttattttacttatttttaaataattccaacttttattttagattcaggagtttaatgtcaggaatactgggaggaaacatgagaaggaggatgactgcttagaattaatttgcagaaccctttcttaaagcaatattttaagcggaaacccaagatacaaaaaccaaaaataaatgaagatgttgatgaagctagagtggatgagtgttaaagttctgcttgcttggaattaaaaaaaataaaataataaaactaaatttaaaagttctgcttgcttggatccctctcttctttatgtctgtctcctctgtgaagaagagctctgcattttcaattagcagactatcactgaaagtgattcaggaaggctactcacaaaaaaggaatatttgtgtgtccagcccatctaatttccaacatgtccagacaagtttattatgcttttttgctatctcccacttcttttggcctttattttcctgttatgaaatatttatgacatactgaaaatgttatttaatatttactcataaaattttgtaaaactttaaactttgcacataaacagataaatatttttggtatgcttttcaatcgatattcatcgaaaaggtttattacttttgtagatacctttcattgttttcattcttacttgtcttaaagtctaaaattaaatcagtatctctacccttttcctaaacaacagatggaaattaaattgttttaattttgatcattatcccttcatttacatgtaattatcatccagtattctgattatacttcttcttaacaccccaaaattatttattataatattttccacattcaatgcttatttagatttacccacatgtttaccacttacattaccattttttcttgcagctcatgcctttcttctgggttcagttttatgcttcctgaagtacatcctctcataattctttcagcaagggtctgtagtggtaaagtctccttctttgtaggaagttgtcttcattttaccctcagtcttgactaagaaattctctagataaggaatgcaatactgacagttgttttctctaagcattttgaaaatattacttcatgaactaacagatttattcctggtacaagtaacatactatccaacaataatgtcttcaacaataaagatgtacacagtcatagctcagtaaatgctggagattggttccaggaccccttcatatatcaaaattcttgcatacacaattcccacagtaggccccacagaactagcacataccaaaagttggcatcccatgaatactgtattttctatctgtgttttaaaaatcagcatgtaagtggacctgcagggttccaacccgtgttgttcaagagtcacctgtactttctaccataacaagcagttcagagctaggcagtactagggttggttaattgagcagctcaatataccacaaatctgagtcagcttctctgtgacacttttggcttttcttttatagttgttaaataacagccagctgcaaacatcatgtcctcacgatgataatgtccaaaggctgaaaggaagagccaagttctccttgcctatctctctctcgctatcagacaagataatcttttccagaaaccttttttcagacttcctctcagccagaattgggtggcatgctcacccactaatatagtcactggcaaagaagaatgaaatattatgacttgcttaaaccagtaatggagtttggagtggggcacatgtttcatacctgaacaatgtaagaattctgttagcaatgcaaaagaggttaatggctgctaggtaagcaaacaacagttttccatacttttttttttttttttttttgacggagtcttgctctgtcgcccaggctggagtgcagtggcatgatctcggctcactgcagcctccgcctcccgggttcaagcaattctcctgcctcagcctcctgagtagctgggattacaggtgcacgccaccacacctggctaacttgtatttttagtagagacggggtttatggtgccattaagtaatctgttgttattctaactaattatagcttcattgtagctaatctgtctgttctatctagttgttctattatatctttatgtatggtgctgtgttagttcatatcatccaagaagcagctgccaagatggaataagatgtgctagagtgttttggaggatcctttgaaggataatggagagggagcaggagaagggagggagaacctttagaatgatgcagggtctgacctgtgaagagggagataagagggaatattaagtaggaagagtttcagactacaatgcagatccaagaaagttttggccaggctgatggagaccccttgaaccaaagttacccattataggggtcctccatcttgtaggaatggcctgtattagtacagtcattggctggaagtagcccataagaagtgtggactcagcatgaatccagtactacattcagaaggtcaggagctggggctatcattcaattatgcacataaatagattgggaggtgcattttcatagctgccttagataatctaactatgaattttcctttttcctactgacgggtcatgcttcctgaatctgaaaattttttcagattctcagatttttaaatcagtcttagaatattctccatcatcattatttcttcccattttctttattttctttttctagaatgtttattagatccatatcatatcatttcattctatcctccatgacccttaacatttcttttagatttgtcatctctttatatctctgtgctgtattctgggtaatttcctcagatacacattcaagttcatgaattcttgcttgatttgtgcctcatttgctattgaactttccctttagcttttattttccattgagtttcacattttgatactatatatttttaggacaactttcttttaagtctatatgatctctttttaaaaatagtgctttgttcttatgcttttcattctttctttaaccattttaaacgtatgcattttttacagtctctaaacaagagctgtgttatctgaaattcttagggacctaatcttatagtttggtgaaccttttgtttcagttggattatttccttatataatttttaactttaggttgtgatcttatttgcatttgcctctgccaggctctctaatcctttgtattaatgttaatttctcttactggtagtcattagaacacatggatagtatacactcaactctaaatccatccttgatataggcccataattataaattctcaataacaattttctattgttttcacccagagcccagtccagggcagacaggcttctttgttatccctttgtgtgagtgggcagatttctttcagtatattctttttggaagtgtagcattctgggggtccatatattggcaacatacgggggtttcatttgcaaaaccctaccttatgaagaccaaagtcatcacctcctaattcgacaaccttagccttaaaacccatatctttatgttacctacttgcagagaagctgcaacatagactcctgaacatgccactcaggtttaaaattcccaccttggttttgactcctgttttgtttttgcttttgtttccacatattgtgagctcaatttttcatttaaaaggacacatgcaatgtttatccagtatttttacatgttttttttttttttgtaggctaaaactttttacattttctagtccaccattattgccagaagccgaattcttaattcctactctatattgcctcagggtagtttggttaacaaacagcaaaattcacttgccatccacacaccttctctttatagcataagaaatcatgatattagaaaaaaaaatcttgatacatctggtttcagagaaaactgcagtgcttccaaggcaactagaagaggtcacaggcatgcttaggcagataaattctagagaatgttttaaccaagcttgccattgtatcactaaaggaaaagcagaggtcttgcttgagagtattagaaaggcacattgctgcttttttagtgtaggacatcgtttgattcaaggaaattgccctaaatgttatgttttcgatcatctactgagaaacagtgaggaaataatcctacaatgacccagctggctagttgcgtaagttataaagttttattttgtcaataaagacttacttttcttaagaaggtttgtgttcctgagtcctataaaaactggatgaaaagaagttggctgctagattattaccacagatataaggtcccatctagtggcaaatgttcctgcaaactgaggtctgcacaattcatgaaaataagaaaaggttcattttttggcataattgacaaagtatgacatatcagccctttcaacatcagctttttaatgaaaatcttcttttatggcacagaaaaaaatttgtagtatacaatattattttagagtttttaccgagatgatttcagattattatttaccaagtatctattctattttaaagaccatatttttaaaaaatgtttacactttttatatgccatttaaggggcaaattttttattcatttaatatagaaaagtctcataattttaaaaacttttgacagtactagttgaatcttaccccggaatattccatggaaagagtagtataaagaatgtagggggacagggaacggtggctcacgcttgttatcccagcactttcgaagccaaggagggcagatcacttgacgtcaggagttcaaggccagcctggccaacatggcgaaaccctgtctctaccaaaaatacaaaaattatccgggtgtggtggcgtgtgcgtgtagtcccagctactcaggaggctgaggcacaagaattgtttgaacccggaaggcagaggttgcagtgagctgagatggtgccactgcactccagtctgggcgacaaagcaagcctctgtctcaagaaaaaaaaaaagaaagaatataggggatttggttcacctgcctaagagaataaactattttaagaactttaaaagcaatagtagtacaatgaagatttttattgtttttctttaaaccagtgagtctagaaacttctataggatactagtaagtagtgactaacattcatacagtgcatttgaaagtaactatcacacatttatattttaaatattatatggacttaacacttaatacaacttgactctccaactggcctgaattaataggatttttaacatctttctacacattttcttaaatgtaaatattttatatgctgagggaaagtagtttctttctcttaagctgttttcttgaggaatcattacattttcatgactcacacctttgaattttatcttttcttacaattccaaatcgagctgttcatgtctcttctctattccaagcaattctttgccccattcattttgaagatgtgatcagagagtaggtgtgagtggataatattcaattcaaacaacatgactacacataatttaaagcatccagtgcattttaaactgacatttaaggattgcgctggactaattcatcctgccttcttcagcttacgtatttctgtgcataattccttcttgaagttaatgggaatttggcatgtggcaggaatacatgtttcatgaaatgggaatctgggatctgtcatttaacaagaaatctgcttctaccttaattggtctgtctccctaatgtctttcactatactatagcagcataggctggccttccattttaatgtttaatgaaactattttaaattgaagactatatatgggttaccatgaacagaaagaaagtagtatgatctatgggactgaaggtgggagagttttgaaatgttgtgcttactgaacatagcttaaaatttaaaagttctgtgtgctacattgtaaacattttaattaataacacattgtttcactcacccatgccagtaaatgctgaaaaacatcttattcaacaggctttagaactagaactttatttttatgatcttttaaattaatttttatttataattgataaataataactatacatatagaactagaattttaaatcaaagaaaaagtaatggtttttctagttccttagtgctgtgcacggtgtattggagttcagcctttatatcagtatctacattttctaagtttcagttatgcaaatatgtacttcctatatgtaggtgaaataatttttagcatataaaacattttcaaataatgatcaataatttgccaacacattgaataaactataagatccatgaagggaatactatgcaggcttaaagaaaaagaacgcaagaaagatttctatacactggtatggagagatctcaagatgtattgtcaagtaaaaaaaaaaaaaaatggtctgggtgcagtggttcacgcctgtaatcccagcactttgggaggcccaggtgggaggattgcttgagcctaggagtttgagaccagcctgagcaacacagccaaaccctgtctctacaaaaaaaactaagaaatttagctgggtgtgatggtgcacacctgtggtaccagctactcgggaggctgaggtaggaggatcacttgagcccaggaagtcgaagttgcagtgagctgaggttgcaccactgcattccagcctgtacaacagagcaagaccctatctcaaaaataagtaaggtgtaaaaatgtaaatataatatactatgctttgtgtacagaaagagtgatattataatatatattctgatattctgtactggtgtgaaatataatggaaagatgaataagaagctagtaaaaatggttacagggggtggaggagaaatgaagtgggtggggagaaaagacaaagtgaaacttactgtacacctctttaaacaatttgtttcttagcttgttttgttacaaagcatgttaatgtaatgaaatgggaagaaaataaatttaccaatacacaaaagatgttttaaactgctttcttccaggaatatataagttaaaatgttggacctggattttttgtcttgactctgccactaattagctatatgatgttaggcaagtcactttactcatctggacttcgatatctgtaaaataagtaagttagaataaatagtttccaaggccctcctcagtcctttcattctaacatgcaaacaggtgacagcttagtttaggtgtacataggtcaactttttaaggattggaattgtgtctgattgataagaatatttattggtactctagagttcttctgctttggctaattttttctccagatgaaataatacttaaaatgagttttctcactcagtcagatagatacacattggatataaattacctttttaaaaagcaattttgctgcttttccaaaaagaatttctgtcttttaactttacgcaaaatcttcatacaaatatttactaaagtatcataaatgtactgacaccagatgaactcaaaacattgacttttaattgctaatcagtattttgataagcttctgagtctttattaaatatgtgttcatgtttgatatccattctgtttaggcttcaattatttaattacaggtcttgatatgaaactaatcatgcatatatccatacgaagcttgtatactgacaggataaaatcattaaacagtcattactgtaaactgacgttggcctgaaatttttgcagttaacgggggagttgatgcttgatgaacaatccaattaaaactggcaacaaaagacctaaaatgtcagccaaattgctttttaatagtcaatgtagccatcacaaaacataaacattaaagtccccatagaagcataaagcttcatggtgaaacaattctagaaaatgaataataattatagcatcttgaggattcttttaatagacatgcactcattaaaaatattttgttggttggaatcagatgacaaagtatgtttccctgaatattttcttacatttgttataataataattgtatttaacattagataggtgtaatttctattttctaaaaatgttattttaaaagcactttaataacctagaatacaggttttgaaaaagggaataagaaaaatgtacaatatgacctgctaatatctcaaaatacaaaatcataatgaatcctcagttacactgaactttaaataaaacacaggaaagccaattgtgatttctacaagtaatccaaaagcaatggacaacatttagattcttgcaactctctgagtgttcaatactgaatatgtgaatggattaatcacccagatgtttcctgctattcagcagtttgatttttagttgaagatacaaattctattatttgcatttttcaccattggttcagatgttttgcacatggaagccaaagaattagattgccgtgaaagattatcttgtatgttatgaataatccaacttcttcctctatcattactgccacatctttgaacaggcaaagaaagaaattgtggggttttcatctttgtaacattgtaacacaaaggaaaatatcaaatggctcctagggaaaatgttgaaagcatcagggttttaataataagtcatttattttctcagtaaacatttgctaaacacttataatgtgccaacatggtgttgaccactctgggaatctggagatgagaaagatttggataccatctgaagcttattatttagctgaaggttagacatgtaagcaatcacatacatgggagaaatgtataaagaattcaagccaggaaaataaaaaatacttatctcccaaactcacatgtgaattaggattatcctttagcctaccatatttttaaaaatactttgtagcatagatacacaacagtagagtcctcagacagatggttttctaatatgtttatgtattaaaatatctttcaattaagtattgccttcctctacaatcatagagtctaattttatgtgctatgaaggataaattgacgttcacacttctccagctgtggttcgtgtgttttatctgttgggaaagttagtgctctgttttcagagcaacaatttttaaaatccctcagaggagagatagacacattgggacttcaaagtctattagctgaaacactgaggagaaaaccctataggaatataaatgaaattttaatagcaccatatcagaaaatattaaatgacccaactatccataaaaatttgcttatcttttaggtttttttcatagtacaatgatgactaaattatagagagaaaattctaacatttaggctatatctctaaaccaccatctcagcctgtgggaaaataaaaatgccttggtccatattatgcacgtcgtcgaataaaatcatgtcagcaatttggttaagtgttggcttgaacagaccaaatcagccagctcctttgctattgtatgaaccacagaataataagtttaagcataattttctgcccctaaattaatattttaatatgtaatcattcagtaaagaacaataaagccttcggtgtaaaaaagaatagatagattgatagatctatctaaaaattcttatgaccacatgtaaaattgcattatgtatttttgcatttgcccaagtaaattcaaggtaaatattaatactatttgctcacatatttaatcaggtacctactatgacctagacattgtgcagggcaccaagattcaaaaatgaataataaatagacctcaccttcaagcaactcactgcctcactgacacaacacacacacacacaaatactcatgataatgttggtttctgatagataataagttgtgtgagaacacagaaaggaaaatggaagaaagcatcacagaagaggtaacattgcctaaaagacttccattcatgccttaagacctagctccactgagaagggtgagaagcaatagcatcaaagcaaaggaagcatgtataatacagtactgtggaaacacagatgtgcgtggcttatgcagagtagagagataggggataaagctgctggggtttataggccctactaatgattttgtactatatgttacatataatgaagagccattgtattcattgtaattaagaaaacagttgtggatttattcattttgattattcattggtaatacatataattaaataagctgttaataagttacagagatatcagatatcctaatttaataagaattagatctgtgaataccagggtattatctatagtcagtgtttcctacattctcctgaatatatttaagtcaggtgaagattttctaagatgatttctttataaagcacaattagcatttttttccacaaaagcagtaataaaaccaccatcatacctgtataaaaacccaaatttttatataatattccagtagaactcttaaaagcactcaagcaatgaaattaccggcacataaacaatacctaactcaaggattgccagaaaccatatttttattatctacaattattttaatgttaaaaccaataatgtggacattttggtggcacaaagtactcttgaactacttaattagtttaataggcaacatggtatagaacagtgacttttaatttatttttctcaccgtttcccacagttaaaatatattttgcatcataatatacaaaactgaaacaaaagtttcatgaaacaattaaaatctttactaaatgtgatgttctaggatatattatattctatttcattttttatcctagtcaaaattggtttcataacccatcaattgatcatagccagacatttggaaaacattgttataaatagaatagttgaaaataactggatttgaagtcaaaagatactggattggaagttgaaagacttgggttctttttctgggttctttttactgcttacaatctctatggccttagtaaagtcagttaactcctctggtttttgatatataaaatgggaatgatgccttccatgtctatctcacagactcctgttgtaaggagcaaatgagataatatagtgttttgcaaaccataaaacactatataagtgtaaggaggtgatatccataaaatgagactatacttcatagttatgtatttcatgtgactttcgtgaaccttttaatccttcaaattcactgttaaaaataatttccgtgacggtatctagtcacaccagatgtatgtgaaaataaggttgacaaagtgtttctcgttatgagtaaatgacataagttcaagtagagtgtatgtttttggcctctctgaaagaaatgtgaaacagaccagcaccctttaaactaaaagatagttaaaacaatgagaggaatgcatggctttatattatgtaatttgcatatgtgacacatcttttttgatacatggtgctgctgctgaagttagcctttggcaaagacgtgtcataaacgcatttgcagaacactaataggaagaaatctataacagtgaagagggaagcaggcaaatcattcatttgaaaaagcattgtttagtaaaatattattatgaactacctatgttcagttcttgccttgctaaaaatggatggaaattcaatatgatttgaggatgacttgtctggttttctccattcagtttttcaacaaacatttgctaagtactggctgtgtaccacactgcaggtgctatgagagtcattacctttcaaagggctttatcctctgttagggaagataaaacaagtatacaaatacaaagcacaacattaggcctgttggacgattgcacgaagcagagacttactcagactagctcagatgataaggatttattataagcgtgcatgtccaaaatctgaaaatgaaccaagctctagaaatttcagcagcaggagtttgtgaattttcaatccagggttctgctattcctgacacagtaactgcctcctgtctgcttttttctatatctgtctgttctctttctgccaccacctggcttcatgtgtcttaggaggtattgggggcataataggaaacagtgctataggtggtcagaagagattactgtagcttctttctttagatttcaaagaatggttaataaaaggggtaacattggtaatgggcctcagaagagtaggatgcaaacaatatgggatgaaaggacattcaaggtgggaagtcaagtatgaatgcaaagattcagagatggagagagcaccagtgggtctgttgaatggcaaatgttgcagtgtggctgcaggacaggaaatatgcaaaggtatactgggccaaaatcatacctttttaacccctcaaaaagtgttctaaaacttttgaatttaaatgtaatatagtcaatctacatgtgtacgtattttttaaatgtccaatagttttccaatgtaaaaaaaaaaaaaaaacagtccaaacaaagcatacctcaaaaatgtcttccattggcctttgcttcagtttattttgcagaaactggaacacatttgtcactccattgacaagcttatctagtgaggcatggcactaggcagtgtgtggattgataaaataagaaactccctgttcttagaatttgccatttagttgagggacaagacagacaagcccaaacacaaacataaatgtagcagaagcaggtatttttatacagctgtcactaagtactttcacactccctaaacactatacccagatattaccacccaatctccctcattggcttccttgcttacctattcagattcctttctcctcagtgtgctctaagcttcacagcaacataaaaaggtacctaattggttctctaattgaaatatctggtcttgggtttaaagaccatctaccaattgctgtccccacgcctgcactcatttgactatgtccatttaccacttctacctagtcatgctctcctctccagggaggcaaacttatttgtcactggaaaatattgtcctttgaggacctgaggtcttaatagaaggcagaagagcaagcaatgatcactgataaaatttgattgcctttgataaagtaacatgaataagggctttaaacataaatttctttataaacgttggattcaagtttagccaaaccctgcaaataaccattatatgttaaataatcaagatgtaccagcaacagtttttcccttgctaattctccaggacatagaaggtaactaatccaaggtgacacggttacaataggattcaacaaagtctagtctgttctgggatagaaaggtatattttgcttctttggaatgccctccagaaatagaagactatatctagggtgaacattccaacttaatcctaaatctgagagatatctctgtgcctattacctgattcagctactgacatagcactgatcaccttgtaaagcacacatataaatggctctacaatagagacctgttctcacatgaaacctagaatatttgtggagtgattattaatggattaatgcgacatttagtagttgcaactcagctgagaataggagatgagctcctggagacacaaagaacctcatgtctcaccatttcttctcactgactaagcttttcaaaggggtgtgtgtgtgtgtgtgtgcgcttttgagagaagtgactttcaccttcaccattatacttgggcacatagcatacctaacacttaataagcagtacaaaaatgtttgtttagaaaattaaatagctggcttgggctaggaaaattattaaatcagcattagcatgtctataatttttcccctctcttaattgttatatttacttctgctgctctgccattccctcgtaccattgcccaagccactgaggcaccctgctccctttcattagggccatttcccttccctgtgtatcatacaacttttctgtgaaaccttgtagactagtctgttctctctttttcaactctaccactgtttacaattacctgctcatcattccattgtattaatatgcatgtgcttaccctcctcccatgtcagttacataaccttttctgatgaccatccactattccttttggtgatttttcaggcagatatatctgttaggggaagaggaagaagggttaaatggcagatttatttctgtaatctttggaatgaggttagtcagtaaagactacacaagtaaagactacacagtaaagactacagcatcatacacaagtatgatgctgaccattatgtgtaaagctggaaagtgattatgacctggagtaaaggcatactcatctcaatggtcaccactggttgaccatgtaatcttcaacaaataacataaattttccatgcctcattttccttaccttatatttaaaggtaagtatttattgtaccagcaactttataatcacaataacttaccacatcttataatgagaatgatgattggaatgatatataaatggaatgctatttgcacctctctgtgtataagagagctgaaaatgattaaatacagtaacaaatcatttactcagaatgtctgagacctgacctgttctattatattggaatttagatatcctagttccaagtgagcataacaattttaaaggcatgttagctaatcaatttatgctatatagtgtaagatgcaaagtatagtaagaaataagttttaaaaccatctgtcttagaaagcatgacacataatatggaatgtaagatatggtagaaaataaacaagtttttaaaacatgagttgaagaaaacatttatttagtgttaatacattatctagatgagttggtgctatgtatggaattgtgtcccccaaatttatatgttgtagccctaaccaccaatgtgatagtatttagcaattgggcctttgggggatgattaggtttagatcattccatgaagatagggcccacatgatgggattagtgcccttctaagaagagacatactttctccccaccatgtgagaacacaacgaggaagcagctatctttttatttttcatggaagaaaatatttgcaatgtatttaacacaaaaggattgatattgggctttatgtaataatttcaaatcaattgtaaaagaccaaacatccaatgtacattaaaatggacagaagttataaagaggcgattcagttttaaaaatgaaaaaataaaatttaaatggctaacaaactgtttttaagatgctccacttcacttgtaatcagaatacccacaaaaagttgtttaaaattataatccatttatattatagaatactatggaagcattattttttaaattaaggtctatttgtatgtacatacgtggaaagatctccaaatgcatttcttagaaaaacatgctacaaaacaatggaaatagtatgatcccattcatgtttttttatttttttatttatactttaagttctagggtacgtgtgcacaacatgcaggtttgttacatatgtatacatgtgccatgttggtttgctgcacgcattaactcgtcatttacattaggtatttctcctaatgctatccctcccccctccccccaccccacaacaggccccagtgtgtgatgttccccgctctgtgtccaattgttctcgtcgttcaattcccacctatgagtgagaacatgcagtgtttgattttctgcccttgagatagtttgctgagaatgatggtttccagcttcatccatgtccctacaaaggacatgaactcatccttttttatggccacataatattccatggtgtatatgtgccacattttcttaatccagtctatcattgatggacatttgggttggctccaagtctttgctattgtgaatagtgccgccgtgaacatacgtgtgcatgtgtctttataatagcatgatttgtaatcctttgggtatatacccagtaatgggatggctgggtcaaatggtatttccaattctagatccttgaggaatcgccacagttttccacaatggttgaactagtttaccctcccaccaacagtgaaaaagcattcctatttctccacatcctctccagcacctgttgtttcctgactttttaatgatcgccattctaactggtgtgaaatggtatctcattgtggttttgagttgcatttctccgatgaccagtgatgacgagcattttttcatgtgtctattggctgcattaatgtcttcttttgaagtgtctgttcatatcctttgcgcactttttgatggggttgtttgatttttttcttgtaaatttgtttaagttctctgtagattctggatattagccctctgtcagatgtgtagattgcaaaaattttctcctattctgtaggttgcctgttcactctgatggtagtttcttttgctgtgcagatgctctttggtttaattagatcccatttgtctattttggcttttgttgccattgctttttgtgttttagtcatgaagtccttgcccatgcctatgtcctgaatggtattgcctaggttttcttctagggttttctttggttttaggtctaacatttaagtctttaatccatcttgaattaatttttgtataaagtgtaattccctttgaaaactggcacaagacggggatgccctctcgcaccactcctattcaacatagtgttggaagttctcaccagggcaatcatgcaaaagaaagaaataaaggggattcaattaggaaaagaggaagcagctctcttaaagcagctatcttcaagctaggaatagagccgtcaccggaaaccaaccatactggtgttgcagaacattctctttagttcagctaaaatcaggttcttgtcacacgaccaggaaagatgaggcttgcggacacatagaagggtgaggagtggaatttactgggcaaaaaggaaaaaaaactcagcaaagtgagatgctaacaggccctccacttcacagattgaatcccaggtcaccacacaggaacaggagaggttgggctcctccccactgcaaatggggagaacttcctgaggctccaccccttcctcccagtgcacaggtgggctgtattcagagacaattagtcgtgaaagggtgggcttcatccgggaccagcagtctggtttttcagccttcaggctattataggcttgaaagcagggttttgccggggactcttgactgtcacctgtctctatcactggtactttgaacttctagtctctgagctgtgagaaaataagtttctattgttttagccacccagtcaatggcgtattgttatggcaacctaaaccaagataatcggctatttattattttatttatttagaaatatggatgtatatctccaggttttgttggctagcaagcacatatcttttacttttatcattacttgacacagcccaaattttccaaatacaactgattatttacattaaggaataggctgtatgatatatatgtacacaattcagtgcattaaaatggaactggagactattattctaagtgaagtatctcaggaatggaaaaccaaacatcgtatattctcactcataactgggagctaatctatgaggatgcaaagacataagaatgatacagtggactttggggactcaggaaaaagagcaggagggggtgagggatgaaagactacaaattgggttcagtgtatactacttgagtgatgggtgcaccaaaatctcacaaatcaacactaaagaacttatgtaaccaaataccacccgttccccaaaagcttatggaaataattttttttttaaaaaactatttctatctattaaaacatacgttattaagaacactacaattcttgggttaccagcaaaatctgtgttgatgaccatgtaattatccattataacttgtctgccctattcataacgctttcatttgtccactgtgatattgctgacccacagaatcacactatcgccatgtgatttaagtaaaataaaagattgaattatttattcaattatttatagataaatattccattcaatgaagaaatggcatgactttttattttgataaaaacacataaaatataccatcttaattttaatataccatctccaattttaagtgtatggtacagtagtgttaactatgtgtacatttttgtatagcaaatatctggaaccttttcatcttgcaaaatcaaaaatttatacccattaaacaacttccctcttccccctcctctcaactcctggaaatcactattagtactttctaagagtttgactattttagatttagattcctcatataagtggtattatgtagtatttgtccttctgtgtctgacttatccacttagcataatgtcttccagattcatcattttgtgcaaatgacaggatctccttttttaaggctgaataatattcaatcatatgtatatgccacaccttctttatccgttcctcccttgatggacgtttagatttcttccacctcttggctgtcctgagtaatacaatggacgtgagaatgcaaatagctctttaagatcctgttttccactcttttggatatattctctttaatagggttgctggatcaaatggtaattctatttttaattttttcaaaaaccttcatacttttttccatagaagctgcacctttttacattcccaccgacagtgcacaaagattccaatttctccacatcctcaccaacactttattttccatttttctttatactggccatcctaatgggtataagataatatctcctggtggttttgatttgcattacgctgatgattagtgacattgagtatcttttcatataccttctgtccatttgcatgtcttctttagaaagatatctattcaagtcctttgcccattttttaatcaagttgtttagtttttctgtttgttttgttttgttttgttttgttttttctgctattgaattgtatgagttccttttctattctggatgttaatctcttctcagctgtatggtttgcaaatattttctcccatttcataggttgtcttttcactcttttgattgtttcctttgctgcacaaaatgaacaatcatttttaaagccctttttcaaaaaaattctgttgttcagatacttctactcattatactcccgtataaacaaacttctgttaaaatgtttagggaattcgaatgcttttgtttgtttgtcttacattttcagttctttcaaatggagatgttatacaaattgagtgtattagtatgttacattatgaagaatacaataatttacgtgtaagaagttccccaaatccataaaatataaaataacattcaattcacattttttaacaagacagctctctagtatccctcgaattttaagactagattttggcatacctatgaagtgctacactatgtatttatttaatacagccaaccattagaactattatactgagtgacaaagatggccgaataggaacatctccagtctacagctcccagcgtgagcgacgcagaagacggctgatttctgcatttccatcagaggtaccgggttcatctcactggggaatgccagacagtgggtgcaggacagtgggtgcagtgcaccgtgtgcgagccgaagcacggcgaggcattgcctcactcgggaagcgcaaggggtcagggagttccctttcctagtcaaagaaaggggtgatagacggcacctggaaaatcgggtcacttccaccccaatactgcgcttttctgatgggcttaaaaaacggcgcaccaggagattatatcccgcacctggcttggagggtcctacgcccacggagtctcgctgattgctagcacagcagtctgagatcaaactgcaaggtggcagcgaggctgggggaggggcgcctgccattgcccaggcttgcttaggtaaacaaagcaggccggaagctcgaactgggtggagccaaccacagctcaaggaggcctgcctgcctctgtaggctccacctctgggggcaggacacagacaaacaaaaagacagcagtaacctctgcagacttaaatgtccctgtctgacagctttgaagagaccagtggttctcccagcacgcagctggagatctgagaacgggcagactgcctcctcaagtgggtccctgacccctgacccccgagcagcctaactgggaggcaccccccagtaggggcacactgacacctcacacggccgggtactcctctgagacaaaacttccagaggaaccttcagacagcagcattcgcggttcacgtaaatccactgttctgcagccactgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggtaaaaacagaacagaaaaactggaaactctaaaaagcagagcgcctctcctcctccaaaggaacgcagttcctcaccagcaacggaacaaagctggatggagaatgactttgacgagttgagagaagaaggcttcagacgatcaaactactccgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaataaagggtatcagtgatggaagatgaaatgaatgaaatgaagcgagaagggaagtttagagaaaaaaaaaataaaaagaaacgaacaaagcctccaagaaatatgggactatgtgaaaagaccaaatctacgtctgattggtgtacctgaaagtgacggggagaatggaaccaagttggaaaatgctctgcaggatattatccaggagaacttcccaaatctagcaaggcaggccaacattcagattcaggaaatacagagaatggcacaaagatactcctcgagaagagcaactccaagacacataatcgtcagattcaccaaagttgaaatgaaggaaaaaatgttaagggcagccagagagaaaggtcgggttacccacaaagggaagcccatcagactaacagcagatctctcggcagaaactctacaagccagaagagagcgggagccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaaggaacaaccagtaccagccactgcaaaatcatgccaaattgtaaagaccatcgaggctaggaagaaactgcatcaactaacgagcaaaatcaccagctaacatcataatgacaggatcaaattcacacataacaatattaactttaaatgtaaatggactaaatgctccaactaaaagacacagactggcaaattggataaagagtcaagacccatcagtgtgctgtattcaggaaacccatctcacaggcagagacacacatagcctgaaaataaaaggatggaggaagatctaccaagcaaatggaaaacaaaaaaaggccgggattgccatcctagtctctgataaaacagactttaaaccaacaaagatcaaaagagacaaagaaggccattacataatggtaaagggatcaattcaacaagaagggctgactatcctaaatatatatgcacccaatacaggagcacccagattcataaagcaagtcctgagtgacctacacagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacattttgttcagcaccacaccacacctattccaaaattgaccacatagttggaagtaaagctctcctcagcaaatgtaaaagaacagaaactataacaaactgtttctcagaccacaatgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagacggaaatttatagcactaaatgcccacaagagaaagcagaaaagatcaaaaactgacaccctaacatcacaattaaaagaactagaaaagcaagagcaaacacattcaaaagctagcagaaggcaagaaataactaaaatcagagcagaactgaaggaaatagagacacaaaaaacccttcaaaaagttaatgaatccaggagctggtgttttgataggatcaacaaaattgatagaccgctagcaagactaataaagaagaaaagagagaagaatcaaatagacgcaataaaaaatggtaaaggggatgtcaccaccaatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaacgaaaagagtccaggaccagatggattcacagccgaattctaccagaggtacaaggaggaactggtaccattccttctgaaactattccaatcaatagaaaaagagggaatcctccctaactcatttatgaggccagtatcatcctgataccaaagcctggcagagacacaaccaaaaaagagaattttagaccaatatccttgatgaatattgatgcaaaaatcctcaataaaatactggcaaattgaatccagcagcacatcaaaaagcttatccaccatgatcaagtgggcttcatccctgggatgcaaggctggttcgatagacgcaaatcaataaatgtaatccagcatataaacagaaccaaagacaaaaatcacatgattatctcaataaatgcagaaaaggcgtttgacaaaattcaacaacccttcatgctaaaaattctcaataaattaggtattaatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaactgcttcaaaaagaataaaatacctaggaatccaaattacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaccaatgactttcttcacacaattggaaaaaactaacgttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatcccttccttacatattatacaaaaattaattcaaggtggattaaagacttaaacgttagacctaaaaccataaaaaccctagaagaaaatctaggcattaccattcaggacataggcatgagcaaggacttcatgtctaaaacaccaaaagcaatggcaacgaaagccaaaattgacaaatgggatctcattaaactaaagagcttctgcacagcaaaagaaactaccagcagagtgaacaggcaacctacaaaatgggagaaaattttcacaacctactcatctgacaaagggctaatacacagaatctacaatgtactcaaacaaatttacaagaaaaaaacaaacagccccatcaaaaagtgggcgaaggacatgaacagacacttctcaaaagaagacatttatgcagccaaaagacacatgaaaaaatgctcaccatcactggctatcagagaaatgcaaatcaaaaccacaatgagataccatctcacaccagttagaatggcaatcactaaaaagtcaggaaacaacaggtgttggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgccgctataaagacacatgcacacgtatgtttattgcggcactattaacaatagcaaagacttggaaccaacccaaatgtccaacaatgatagactggattaagtaaatgtggcacatattcaccgtggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctgggaactgttgtggggtggggggaggggggagggatagcattaggagataaacctaatgctaaatgacgagttagtgggtgcagcgcaccagcatggcacatatatacatatgtaactaacctgcacattgtgcacatgtaccctaaaacttaaagtataataataataaaataaaatgaaaaaagaactattatactgagtgacatatgtagtgatactatttctagagtttctagttgaattaccataaccctaaactatcctcataattatctattgttgtaatctaacatgtatttagagaaggaaaatccctacatgtgactcatagtttaagataattctttttattgtaataacatttacttgaagccaatttggtatttcccatagtagagagatggtcatcatgaatgccagttattgtattaaataagaattttttttaggtacataatatttcatttgtaaatgtggttaaactttaatgtgcaggaagaaaaacagcatacataaattgctcagttgtctttttaaagcaagcccatcaagcagcctcttctgatattttcagcatcaacttgggataaaatgacacaccaaataagctaacaactgttactatagattacataaattatgtaggtgctactgaaatgaagatatttgctactcaaaattaaaaggaaacatttaatgatgtgtgcttgagcatattgaatcggacttacaaataaaataacccactacatagatttcattataagttattacatagctgttcagactcagcattttatattaattgtttgcaataaagaggaatgacaagattggtataagcacagttggtgttgtttgttttgaaggccaggagagatggctgagtggcaacaaatggaatcagtgcaatactatggtacccaaggccttgcactaagttctccacatctctcagactcatattctccatctctaaaatgggcacagcatatgaatgttgaaacactgtgttttcttcaaggctgtggaagttatttatagcctcagaaaactttaaaaattacacattcttaacaataatgactctttttttcaaacagtccattttcacagcataccagttatgtgaacaagaatgtaaaataagagagactagagggccaaaaataaaaacactaaaaagaagtaaatgaaacttgtgatatctccacagtcagtgtgtctaaattcatgttatttttttcatggcaccaataaaatttactaaaactttgtaggtcacttatttcatttgggttataaaaagtctctaatttgattctgtcttccccccagaaatgattagccactcgttttaatggaatacccacagccatagtcttcatgacaacaagactctgtgtaaatggtttcagttggaaggtgggaagaggccttaacatctgtgtagccttacctctccccatcttggtctactgttccaacagaggaaggggacatgtttttcttttcttcctactttgcaagtatatatcctaacaggcataaggaaaagaagtaatagttgtagcagtagcagcaacagcaacaaatgtgaatatatgtaagtcatcactgaattctttgaaagaaaattggtttcataatctaaattcatactggaaataattacaataataattatattagtaactaacattaactgaatgtgtcacatgtaccaggcactatgctaagtatttgacatacaatcctggtctggtacccatgctgtttacatatactataattaatatgcaatgctttaatgaatatatttggatacactatgaggcaagtcgtatgtcccaaattaggttgatacacagttacaaaattgagcagatagctttcatttataatgtggatgttggtcttaatgccaatatgataaagttcctgtttatttgctatgagcggtatacctacaaagcgccacatttctaaatagtcgtcatcgtttgttaggtggtatttttgtatatactatttaaaaatgtttctgagcattcctgacacttcaaacggttatccacaactccttccctcatggggtttgacgtactgtgagggaattatttgaaagccagttttgcttgcagcttggcccagtgaataaagcatcagataatatttgtgaaagtctttgaaagatgcagatgaaaggtgcttcataaatacaaagcactaatgttgtattcatggaaatggctcttcttcacatcctttgctctaatgtctgagtctcaaggtgttattgcaatggatactttagaaatgcatgtatacccccagatcattttagtatagaggaaaatgcaagtgaacacagtcagagtacttaactaaaaatcatgaaatagagactattatctgaagtgaaagaaacttgcagcataataaagaagctgatcaatagagagtgtttggtgtggcttggaggaagaggaaaagaaaggtgtcaactgttcttatattgactcatgacttcaataatagcttcttagaacttttagaagaaaataagaaaactgaaaattgtgaaaaaaaatcaactataatgcagaagttttaagtaatcaagtgtcttggagtcaagtagattatcctcttaggctacttactagatggcacctgattttatagatttcattgagctcaataattgatcattcatttaataatattatttagtgcttactatgtgccaagcactctgctaagtgttttgtacacattacctcatttatttcttacaaaaaacattgagatgcttattactatccttattttacagatgaagaaacaaaggcttgaaaaggtttatagcaaactgatagtaaatgacagagctgtgatttaaaccgacataggtctgattctaatatctgtaacttaaccattgtgtcattcgaaaatgttatgatgtacttactaatttaaacaagttatatacagatgatatctctaagtaagtaaattagtagcagagaaagtactctacacttgattcaccttattgaaaacaaacaaatgaaactaagacactctcctctttgtcttctactactaaatataaggtgttccctaaacgtttaggttaatttctccttttctttggcttcctcatcatttattttgtaagttataagtaggataagccctactttaaagaagagtatagttcagtagtagacagcacttgaccttttattctgtacacataacaataaaatttaaatatatatatatataatctctctctctatatatatatctgtataccttgacatgcaacccattttgtatgtttatcactagaaagccctatgatacacaatgttcaaaactacccagaatgggaaacatctaagtcctgtactgtaagtatggaaaagaggaaattgccctagtgctgccagggcaagaatttgaagatcaggtagctggtcagtaagcctaagtgacaatggcttcctgagtaatggaattatgctttacataagcagtttccaaatgctgatgagaccaggagcataaaacagagcaattccatagtagtatgttcttttaccctgagggggagacagctcactctgtgtgggctaccaaaaccagaaaatgagggcttgtctccatgaagtacaggggaagcaaaagggaaccatgtatacatgcttgcattttaatttcatttctatcctttgtggtacgtgtttgctatttgggagtcaagaaaagtaaaagcaaacttgaatcaaatccaggttgtcatcattcccatccaggaacccagatcacactctgtggtctgctctggtccagacctccagtgttaatacacagaaaggagcgtctgtgcattcattcactgacttcaggcactacaagaagtctctctgagaaactgtttcacataagtaatgtatgtttaatctactgtccctctcagcatctcacctatcatacatatgtattttcacaaggtacatgagtaccttttgaaaaacttacttgaatgagcttaacgaagaactaaattgcttaagagataggttggtgcaaaagtaattgaggtttttgccatcactttccatggcaaaaccgcaattacttttgcaccaacccaatacttgcttaaaggacatatttatcaatcactacctatgaaatcatttcttaatttctaggatttccatctatatttactactgcagtctcatattcacagcttcattaacatgtgttctcatttttttcttctgtttatgcaagctgactctcttccccttgagatgagctaatttttttcattttctgaaggcatctatacattatgttcatttcgctggaggggagtacctgcattcactgttgttcaattcattctaatatcatatgagcagattccactaatttgcgtttttattttttttaattttatttatttatttatttatttatttatttattgaaatagtcttgctgtgtcgcccaggctggagtgcagtggtgtgatctcagctgtctgcaacctctgcctcctaggttcaagcgattctcctgcctcagcctcccgagtagctaggactacaggaacgtgccactatgtccagctaattttgtatttttttgtacaaaattaataaatttcataatttagtagtttggtttcactatgttggcaggctggtcttgaactcctgacctcaggtgatccacctgcctcagcctcttaaagtgctgggattacaggcctgagccactacccctggcctaatttgcttgatagacatttcacttgatccactagcagacacatctatatcaatagatcagtatatttcctaattgagctgccttctcacaacttcattagccatattctagttaatgaagtctcaagtgcaatctacacatagtttgaggctacatgtgaaaagacatcattacaaaagaatttatcagataacttttttgtattctgggtgatgttcatccagaatgttgcattttgtttggggaaccataaagacctagttaaattggagtgagtccggggagataagcagtaatgtaattgagagaatgaatcagactttgaaggaaaaataaaatgacttaaatatgcatagcttagcataagcaaagtttataagataggcttagtaataggttgtaattttggcatatctcccaaaaaatagctctatttaacatttcactaaaatgccatgttgaaaaacaagaagatgaaaatttgtaataatgaatcaatcaatgaacatttcaagcagaaaacttttcagatacaggctgtgcccacacaatgccaaaacagctgttaggaatgtgaataattcaatcaaataagttatttggcatcataaaacactctcacccaccatggttgctataacttttttataaaataaaacttgattgaattcaaactttaaatttttgaattcactcaaattaattaaatttgtaaataaacaaaataataaacttgaataaaattatgggttgtatgtgggagatataaagatgattcagactcacatcctgatacaagacaagtatatgcatagcttgaatgcaagaggggaaataaaactttctctgtccttcctacagaattgttactttcctgctcatacttcttaggaggctccctcactagcccattagatgtcagacagaaagattggtggcagccagtagtgttctaccagcaatcattaagatcataattctgaaaaaaaaatgttttggccccgacatatttgaataacatgtacatgttactcatatgagaataccaggactcctttttttaatgcttcctatttcctttttgttgttgtcgttcagaggggaaagataagcaagtcttcgtccctcccatggtatgagtagaatcactttacaagcatatggatatgaaaatcacttattacaattgcttataagatcagagttgtacccaattcctatcactagctataaccccaacccctttctctcccatccaagaaagcacatccaaatgcaactcagtgagagtggcactattagaggcatcaccctgagtccactcatctatactttttaaaaataaatcatttgtgaatttcagccctctattatagcaacaggtgaccgcaaaacattggcatgttttgatcctatatctgagcattgctgaactggagcaaagggccaaaacatgagtgaaatttgagaatcctctggctcttgtgaatactgctataatagtgacatctcttcccattgtcccagatgagggctatgtacttgtttagctcccaattatagatgccagggttcctctccatcactccattaggtgtccatgagtgccctttgttcttaaagttgtgctggtggagaggaactatggagtacaggggatctttcttgccaaataaccagacaacggtggttacgagaacattttcttcagcctttatttgaaaaatttggacaagggtgaaacctttccgaggcttccctagcctctatgcttttttatactctagaatttttgccttttgctttttttgtttattcttaatatagcgtgccctcactatttaacatatgatagcttgaaaaatacttttcttgaaacttcagacacagttgtaatgttttcctgatttgtgcttcaaacattgcgttctatctttataaataacattggagcgatttgcattctttgccttttgaacaaatacagggtgaccatttataacagtgtaataaaaataaagccctgaaaatgaaaactttataaatgttcaggatatctcttattagctaattcattaaatgatacactgtcaattaattcataaccctccattacctacctgcaaataaataatgaacttgaagattgaaaataattgaaatacctacataagactttagtttgagtataaactaaatatgaaattttaaaggatcattacttttttatattttctttttgatatacttcactgggtaataacagaagccacaatatcattgtcaacataagataaaacagggcaattatctatttcatgtttcatggtacataacagataacagtttctttcaaggctatagtgaaaaggctttggccaaccactaattttaattgctaactaataccgtatactaacgtttaaatattgacatttaaaattccaaattgtgccataaagtagagctctttaccactctacttagaaaaatgacaattttctaagatgacaaatatattggcttcatttttcttttttttaacattacgaaactactctacaaatattagcagagttatatccatcttgtattttcacaaccaagaaaattaggtagtttgagcaattactacaataatttaaacaaaatggcatttaccacagccttatctttttttcttgattgtaaagtcctggattgtttgactgagttaaaaaaccagacacttattggcaggaatattgagtattatgcctgaggttggctgattgtactatgtaaaaccaatacagtgtacagcacagttggcttccctctataacagagacaggaagaaatgggctgggggagggctgctttgtggatctttgactaacttgtatgcttgcacaacaaattggagaacaggaaaagagattaattaaactagaaagtagaaaatttggactttctggatgtagaccagcactccctctaaagatgagtatcagcttatagagagactaaaatataaatatgaatttcagcacaaacatgtcaaaggatcataggtgctttattgttgaccttcatttccagtgattgtaacaaagatcaacctaactgacagaaattaacacagcatactatatcttacctgctggcttagtgagagggccattcaaagtcctcaaagggatgtacttgacaatccgaaaaacagtaaatagtatccagggctgtggaagccatgcagaatgcagtaatccagaaccaggttgagcccatggaaactagaaaacattgtaatttattgttagctttcccccagagcctctgtgactgttctccttcagtcatctgcttcagttgtgatatctcctctctatttctctctccttctgactctttctgttgttgtctgtgcgtcactcatgcacatgcccatttatacataagtatttattaagcattacctatcgaatggactttatttccattctcaatccaatggtttatttaactgataaatctgcttttaataaaggatgttggtatattaatattaaagcagtattatttgagccagaaaagtgataaactgtattgtttattttcttctgaaaaccagttttcttacctttttattcttttgagcctctaataataattacgaggttgagaacagaacagccagatacatttaagtctaatttgatgatcattgagcactatgaagttaatggatattagccgtaacatgcaaatcttaaaactacctgctcacaagttacaaaagctctttgtgacaggtaaaataccattaagtagtaacatacattttgagttagtagtaatagttaatattaataagaaaatatcttctctttcttttaagcctgtttccttttaccccctactcctgcctagaaggggagggcagctcagaaaagcaacctcaggaaccaaagacttctaattggccttgagagatctgacataagtagtatggcaataactcttggtgccctgatgttctttgcacgtgtagattatatggtcttcagaggcattaattaatattgcctcataagagctcaggaaggtggttaaatactaatacaggcccataatcccttatccaaaacctttggggtccacttttttcagaatttagaatttttcaaattttacaaaggtgctgctgtacatatactgtatattatatatacactcacccagagtgaggtatgggccagcaccccttaataaaatgcattaatactttcttacctaaatgtatgaaaattcacaaaataagataaataaatgaagactataaatgtcctcatatcacttcaggtcaggctttgccaccaaaatttatgaaattagataaataagtaaagaccataaatatcctcaaagcatttcaggtcagcttttgccacccagtgagttaggggaaaacaaactcatttttcagagattctttgattccatagttgtagataaagaattgtggagctacccttccccttggccaaggagataatgaaacacatactaagaccaggaagtacagacatgatttctgactctccgtgacctttttctagagctataggaatatatgtgccccttttgacaacgtacactgcatagtaaccttgggaaaaaacatatttagggaaggtattgtcacagtgtcactaaagaaaagaatgatcaatttagtacatggatttcagaaaagctagccatgtatctactttggtcaaatttttcaagaaaaatgtctatttggcattactgtaatactgacaatatttatttttaacacctaccgaaaattattttgcatgtacagccagtgctgctacagtgctcgttttataaaggttaattttttcctttgccattgggatgtttgagaacagtttgaacttaagacaaattttgcgtttgcatatgcgcaattccatctgttaaaagcactagatgaatgcagaaaactgcatacagcagaatgaactgcgtaagaatacacaaaatgggcacatgtatatacctgcaatatccatcagctatttcagctcaccacatgtggataggagcctgtcccatccacatctggtatttagaagtttccgtcctaatcagataactttccttttcaccacttcacaataactcacaatttgcaactcttctggcacccactttcacaagataaagtgtcatatttggtatggcattcgcgtatcccttaaccattaatatatgacaaactatgctgtcattcttattaggttcctttttttttaatgcgtcattgattatgtttctgaatgttgcatccctaacttcattttttccataaccctttggttaggtgtgattttgcatagtgcagtgaattgcagaaatgcatgctttgtcttgtagcagaactgactgtatatgttaatgaaatgtaagggacaaaacaccctgatagacactctgataagttgccacagtatttctgagcagagatactctaatttcttgtgaaagctttctctaacacattatccaaaataaggtgtattggcaaaaagagaagaaaaggaaaaaagaaaaaactatgcgtgacacgtttcttcttgcacttaccttttggagacagaggcaatgttgtttctgaaggcttatacttctattagtagctctgccacacttaaaatgtctcaaatctacagtttggaggaattttgctcctgagaaattatcttaccaagttattttaggacctcaaacctgaaactggctactatccaagtatattatgtgaattagacctttccatttgaaaacttaatttattttcagaaagctttgtaagtaagtctggatatctacatttgcataatcaccactccccccttctcccttcctctctctggggcacagaagtgtatggttgccagatacatttggaagtgagtgtatgtgactcgcaaacccctagaattggtgttctagagcttctgacactgaacactaatgtatttttcattagtgtttaatgttgggaaatcccatttcatggatcccaagtattaaattacttcatttgggagggaacaagtgcattccccatctttttcctgaggtgaaaaaaagaatgaatctgagatcatttgcatttcataaaggcttaaggtctggatgtattccactcagtgcaacaatccaatattgtgaaagcgtttaaagacaatatgaactagcagggaaacttccacatatttgaaatgtggaaataaaaatacacagtaaaatagatgaaaatcaaaatatccatatatgtatatggatatgcattatacgtagataatctaaatgactagacaaagccattctacctgcaacagaaataataatactatgattgcacttttcaatgaagtaaaatttttatcatttttcataatagagttgcaaagattgtgaggtaatctagcaggcaataaatctgatgtcaatgagatattctttttcttttgaacaactgtactgaagagaaaccctttctcttgcacaactgtgctgacagaaacccctactgattaagctagtaaatgtcatgcatgttgtttagaggggttctgagcacaagacctcaaattgactcctctttttcttctaaccttggacttgcaccttttcctcccttccctcgggtcattaagtgctctcccacacgtggcattagacagtagatctgtagtgtgtcactggtgcttttttcacatcatgaaggggcatcattttaagcaccttcttcagagtatcattgtcctttgtcatggctctgggaggcattccactaagatcttcaaggggaaaacctacttctctgtcaattgaatagatagccagtggctacatcagaatgagagccaaagggaacacagaaggtgattatctgggtcccatgatccagtcaaaccctcttctattagcaaaagattttagagatcttgctctgtacccagtactttgctcaatgtcatacagcatacaggagaagtagaaggaaaccttattctaagaaacatgcagtctattttgggagaaaaggcaaaacacatagaatatgatggggatgctataatattgccaactcagggatcaaatttatggcaaaaatagtaaatgttaaagtcatagaagagagtcatgtttatgttccgaagtagcataatggaaagagtgctgggcagagtactgggatttcagataacataacccatgggggtgggggagagttttaagttcagtctatctgttaaaatgtcacttaatttacaaaaacacgtacagaaaaagagtaaagaaatcatctggcatgggcaggaaaaagtatccaagttgaatgaccttgagcaagtcagttcacctctttgggtcttgggtttctcatctgtaaaatggcgagtggagagaggcaagcttaactaggtgatccctatgatttcttccagccttatagttttatacttttatacttttattacattcaataaagaaatagtcaataaaatgcatgctcaagcacattttacatgaattaaatttaattgttaggaaaagggattattattatccttattttacaaatgaggggttaaagcttctaaagggtagaggcagaacttaaacccagatttgccatacatcccagtccaagtcctctcctctttccactgtgctgtgttgcataccattacaccacactgccttcctttctacatttaaggagtcatggtcaaagagaaaagcagacgtaataaacctaagtgaaaaatcaagaaaatgtggacaattctttgtctctaaatcttatgaaggaaaagagaactcatattacagagatctgcaatacagggaatggagcattagccagagagtcaagagatgtgagttctagtcctggccatgccactaacttgccaagtgtccctggacttgttttctcatttgcaaaatgagagcatctccaaagtcctttgggtttcaacattctatgcttctttgagtccccaaaatggaaagcacacttctagttacggttatgagtatgagcccagaggtttaaaaaaagttaatgagatgttaagtatttgtgatgattttttttagtgaatatgggatttgagctgggcctggaataatgggggtgacttaggaaattcatgaaacattttagttcttttaaaatatacaaggatagctgaccatctaaaggaatcctttttataaaatgaatgatcaccactcccttctctatctatcttttgtacaattcagattttcatatagtgagtttatttaaagggagagccacctgtgctagaaaatacagccaagaatttgtcatgctcttgggaggctaatatcgtttttaaaaataaaaaaccatgccaatgtctttaaaattcaagtttgaagtaaaaagattgaaagaagtgattttttttttttctgtgatcagccactgcaaagtgggcctcagcacaaaccagctgagtcctttgctaggcatcgaaagcctctggcgtttttctgcttttcaactctcagtcatttgggaggtgggacaaggccatgctgtccacaaagtttatccagaacgtgctggtgttacaagaaatcacttgacatctattatgtttctcctgtggaagagaggtggctatcagctacaatagtgatttctttttaaaggggtttaattgaggtatttctcatgggccaaattctaactcactgtctttacgtgtgcctgccaggaaaacaatggaaaaataccaagcaatagcaacaatagaagcctgaggaccgctgtcccaggctgcccctctgcaaacgagcagaaaaaaaatctgtttccttgctgcctaagctgccgctaacatggcagagctcctagaaaggtgtggcaaaggaaaaaagttgcagactgtgctttgcatgaccatggaaatatgtataacaacttgaacaaacttcttttagcctaccttttacaagtagcactctagttggggggctgacaaagagattagtttcacacagccaagcgacacactcgtgagctgtttttctaaaatatggatttgctcccgtataggcaagctcacatcctttcctgaggtaagccagaaggtggccttatatttttatttgaagtgccgaatgattttccttgcaacaaatttgtgccttttactagcattttctgaagtgagaattttgcaactgatggaaatcagctcacttctgttctgtaacttggtgtcttgttgatgatttatttgttcagtagcagaaactatgacaaatggtgtgaggcggcctcatttactttttagctgctatagccctaaagaatttacatgtaaatgcaactgtgaatgttttacatttcataagcatgctgcacgtgcttttgtaagttaagtggcatttttacagatagactgaacttaaaacaacctccctcaccccacaggttttattatctgaaatcctggtaagtctgtcatgctggtttccctgactgccaagtgggagagtaagtctctattttatgtttctcttctctcctctttagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggtacttgagctattattgatcccactaaacttaagtattggcagaggatggttctactgattgcagaaactcatttcatcacacacatctgcagagacacacaaatgcacaaaccgatacacacccagatgcatgggcaaaaaggaagactccttcacaggcgcagatgtgcaaacagacacaaacatctagatccagccacagccacagaccaaagcagatacacgtgaaaagatgaagccgcagatacataaacaccctgctgtcacatatccacaaaaacataaaacaaagcaattatctaagctgtcactgcagcctcaaagtgaaaggcaattgtcccttgttttaaaaaactgcagtattacaagaaaacccaaacacaactggaggaggagtgatcatttctattttatttattgtaagattctttgaaaaaataagttgccttcaaacattaaaaaaaaaaaggatcagcctcatgtaatggaagtatatgtgtaagtttaaaaactaaattctgcctttagggtgaagcttttggtcttttgagcaaaaaagtttgcctctgtttttcttcacatgtttagatttctagattgactcctcagagctttgtcatgataaaagttctactctttgcagttctaggtcccttgatcatgatagattttagcaccagatacaattaataaagaaattattcatcatttctagtcactttcttaaatcaaacattacaactttatattgacatagaaaaacactaactaataaaacatagattctattttctttgaaattcaaggacttccccttgtttttttgtgtgccttatttagttctacaatggaagcttttatttttgttttatttttatagattcggggatacatgtgcatgtttgttacatggatatattgtgcagtggtgaggtttgggcttctagtgtaccctcacctaaagggtgaacattgtacccaataggtaattttctaaccctcactccccgcccatcctcccttttttggagtcccaagggtctatcatttccatttttatgtccatgaatagccattgtttaactcccagttataagtgagaacatgtggtatttgattttctgttactgagttagcttactttgaataatggcctacagctctatccatgttgctgcaaaaaacatgatttttttttaaggctctgtggtactctatggtgtatatataccacattttcttcatccaattattcattgatggacacttaggttgattccatgattttgctcttgtgtattgtgctgtgataaacacatgcatgcaggtgtctttttgatataatgatttatttttctttgggtagatacccagaagtgcattgatgaatcaaatggaagttctattaaaaatcgccatactgttttccagaggttgtgttaatttttattcccaccaacagtgtataagcattgccttttctccacattttcaccaatacctgttgttttttgactttttaataatagccattctgaatggtatgagatcgtatttcattgtggtcttaatttgcatttctctgataattaataatgttgagcattttttcatctgtttgttgaccacttatacagcaccttttgagaaatgtctgttcatgtcctttgcccactttttaacaggaatttttgggtatttttttcttgttgatttgtttaagttccttgtagattctggatattagtcctttcttggatgcattgtttgcaaatattttctcccattctgtgtgttgtctgtttactctgttgattatttattttgctatgcagaagctttttagcttaattaagccaaatttgtctatttttgttgttgttgcatttgcttttgaggtcttggtcataaaatttcttgcctaggccaatgtcctgaagagttttttcctaggctgtcttctagtatttttatagtttctggtgttatatttaagtatttaatccatcttgagttaatttttgtatacagtgagggataggagtccagtttccttctacctatagctatccaatttacagaaactttttctaaagacatttgtatgtaaaaaatgggtataatatactacttgataaacaatgtctggtatcaccttctaatctgatctctgggaattggaatggaaagagaaggactagtcaactctcctaagactggttgttattgtttttgttgtttagcagcatattaaattaaataccaaccatggcatcagagaatatttcaccatcaacaaactgcaagtactatggcccatgtccaggaaacagtatcatccatcacttaccagattaaatggtttcataaagggtgatttctgctacattccaagagaaaaatatagcagtcagcacctatggtgacaataacccaattagaactatactagtgatagagtttctgtatttatttatttatttatttatttatttatttatttatttgagacagtctccttctgtcgcccaggctggagtgcggtggcaagatcttggctcactacaacctccacttcctggattcaaacgattctcctgcctcagcgtccagagtagctgggactataggcatatgccaccacgcccagctaatttttgtatttttagtagagacagggtttcaccatattggctagactggtcttgaattccggaccttgtgatctgcccgcctcaccctcccaaagtgctgggattacaggcgtgagccaccgtgcccagccctgtatcttttcttttcttttcttttctttcttttttaattgaaagggggaggtgagtaaagggtaaaatgcaaagaacaatgtatatcttcttcaaggagttttcaaacagtggttatttcctcattttacttttagttcatttgcagagcttagtgatagagagctgaggaaacaacagggcaatatggttaagtagcagttctgacaagcaaacacactcctttcgtctttgaagccaaataacagaaaatctgggagagagtggggaatgggttcaggcaaatggagagagaaaattattcttatttgaaatgtacatctaggcatgtttgtacaaactgcacccacggaccttctgtatctatgcaaggaatatattaattggtctcagtttcttaagacgcagagaagaacataagttttcatgtaagagtgaacagagtacctttttagtacatttgaacatatatttagcatcacaatgatgattttttaaaagccagaaacgttattagctctatcaactagcattgttcaaatatagcctttaaaatgttcatttctcatgtagtcaataaaggtaactgtgggtatccaggaacttatacatgaactgtgtaacagaacctgtctgagcctcagcctcctcatctgtaaaaatgaatatacaaatgcctgacttcctaattaggaaaatcaaactaacgtagtagaaagtgcctcatatactgtaaagcactacacaattaaaaggtaacattactatccctactaagtggccacttgcctttgcataaatatctccaaaataggtaattggcttattcctaagttattccactctacctcaaacaactactagaagattctttttgaaccaaaatctatcccttcttaactctgcccatttttctcaaatctaattttagggtctcacagaataagtaaaattccccttacaactgacagcccttcactattcttgagtcctctattctttgtgctaaatgtttccccaattccttcaacctgttcctcacattaatgggtttcaaatctcccttcctggtctctttctttagaacactccagtttgtccaaactgctcttgaaatgtaatgttcaaggctgaatgcaggtgtgggttcttattagcctctctggttgcaagaagccagagacattcaggttgcctcgagtaattgagaacatcttttcagtgtatgtgttgtcagtccccgggaacgcgggaaactctggtcaatccccaaaggaaaggcaaagactgtggatctctagcattaataagactcagcagttctctgcatttttgctcctctctgtctgtttctttgtccaatagcttattctttccatcagctcaatatttattttgtctaccacatagtttctactatctcataacgatgtcttttctccactgtaccacatgactccaagagtacctcctcacacctctcacctcatcccttcagctgcatgtcccattgctaactgcattattatcttggtcactgtaggctcaaaaccctaagagggaatttgattagcccagttcatcccttttatagcaggctgtgtttcagttttttggcaagccctggcaattattctcatagtcaactgaggctacggggagagaaaagtcatgtgattaaaataaacaacatggccatctatggttgtcccttgaggaaggaccgtgagcagatttgatgttccttagatgggactctcagcagtcagtcattttgactgattcactgaggattttatgctatgaccaacaattagccacctctcttgttctaattatgtattttcgttaatgctgtctactccagtatcagcttttttggtggccacatgacactatccatacacattgagaacaccggaaactaaaccccaaagcctgtttaacatgttctgaagctaaaccacgttttatttattctgtaagtacatagttgattctttttcagttttgtgtttggtatggaagataacagtggaaatatatttggagccttgatttggcctaatttgatctcatcttgttagcatgtggaaatgttgctgagttctaattctaccatacaaactatttgcttttgctctcagaattatgtcatctgtaggcttgttaggtatgcttccctcttttttatgtaagttatcgatacaaatgttacataagaccagattagggttagatctctgtgcatgccactggtgacatttatctattaggcaacattcttttactaacaacccacatttctccatcttgttcatagccatattatgggagaccttgttaaatgccttgctgatattcagatatagtatgcttacattcttaccgatcttccaatctaataaccatgtcaagaatagaaatgaaatgagattgtctaacataacttgttcttagagaatttatactgcttgctttcttatggttactacttttttcctaagcgctcacaaactgttcttttattaacctgttgtagaattttgtatttaatcaacctgtttcttggtctagtctaaggagtccatatgcttcctgtttattttgaaaactaaagccaatgttttctgtttctagtctcctgtcacacttcaaccacactacagttgctaaaactttagcaactgtgacagggtaatccaatctccaagacctctgaccactctgggatagaattttaattcatttattatagaacagccaaatgccttttaatgactgctttgcctattttagcttcaatttatggttactgatattgattttaccatttcaagtctatcatcattctttttcacaaagaaaactagtacagtagttgagaaggcctctcagatattggccatccaataacaatttcatgggttgcatgtctctcctacccttgctcttcttggtttaaatatattttttaaaaagcacttttctgtcatctttagcagtttttttctcaagcctcaggctcatttggggtataattcttcttagcattattttcatcatgccctcttaaacttacttatttttggttttcatccctttattttggcacctgttcttttgaaatccaaactgaatgtgaatggataacacccagtacagacacactggtttcaacaggttaaaaaaaataaaatataataacttcccaactctcttaattcatctccatattagagtatctcagggcatgaaattgtacctactttacttcagcaagctcttttcctaaagtctgggatttgggccttataaggtacttatggactctaagataaaatacttcacttcctctaaaggttcctatcaccttcaactcaccagtttctctttttctaagtcagtcagagaggcaagtttcttattttctctaccttttgggaggtgtagtcattaacacaaaaatttgggaacttgccatatatttgcattttgcaaatcgatacaactagcagatgtttatggagttgaaatcactcatgtttactaccctttcctcctacgacgcttttgtgatctgtgttgaaaatcagcatccgttgtctccttctggccaagtgtcttattatagactctccaatccactacctattagtcatgtgacattgggcacattaattatcatcaccatgtctcggttttctcatctgtaaagtaaggataatagtaaaacctagctcataaggccattgtgagcattaaatgagttcctaattgcaatgtgcttagagcagccatgaacataatgagcactccgtaaatattagtaataataatagcaataataacacaagagattattttactttttgtccctattgctatctttatctaactaaaggtatttctacccttccattcataatttcctcaaagtaaacatatacaacatcattccacttcctctcttagcatgcttttaaatagaatacacttggcctggcccggtggctcacacctgtaatcccaacactttgggaggctgaggcgggtggatcacctgaggtcaggagttccggaccagcctggccaacatggtgacaccccatctctactacaactacaataattagccaggtgtggtggcaggtccctgtaatcccagctactcaggaggctgagtcaggagaatcgcttgaaccggcggggagtggggatggttcagaggttgcagtgagccgagatcgcgccactgcactccagcctgggcaacagagggagattctgtctctaaataaataaatagaatatactctttcaccaccatgttccaaatcatcagaaccatcccccttctcccacattttgacgatacatacctgtgaggctttttaagactgccctgtgatcaatcttcaaaacagcttgtgcattgctgcctgccttctgtgttattcagaaaaacaatgccctgtctacccagtacattggggattgggccctgccctgagccctcccttactcagacgtcagccttgctatctccttctccaagccttcttctcaaaattcccaatgtctagattatattttgggggcagggtgttttttgcaacccggaaagatgggcacattgccaaagatggagaggctgggtgatgtgtgcaagcatatgtactccaacatccctggactaaactacttatgttattgtgaacttagacacatgacataacttccatagacctgaatttccctgtttgttttgtgtcaaaaatgacagaccctacctcatggggctgttttcagaactgaatgagataatatatgaaaatgtctactcagagccaggcacatagaaagtgtgcaataaatattactattttcaattcagtataatagcctggcacagacctgctggcaagtagatgaattcagagttactacaattcagagagacacaatagctttaatctgctgtaaaaacatccagtattcacatatacttcccagtctatggattattgtgcgtgtcctgcacagcgaggcattcagcaagcatttactagttattcctggtgcactgccgcttctatgaggaatgagaatccctgtattccagaaatgcatggtttagtactagtaacaataacgatatctaactatgctaaacagcattactatatgccaagcactattctaagcccttatgaatcaacttctttaatccatatgctagtgcccatgtggtacgtactatttagtgttgccatcctcaattgagagatgaagcaactgaggtacagagaggttaaggaactttgtaaaatcccacaggtaggatatgacagatccaggtcaggttttgaacctaggctgtaggtctagcatcttcatatttaaccactatgcattactgactttctgtagtaggggaagcaaaggtaaataaataacagtaccatcacaagtgttttgttatatttaagtaatccaaaggtaagaacccttggaggggggtagatctaaccaaggtaggaatagtagagactaaggaagtgttcaggtaggtagaaggggggaaagtcgaaatttccctgagaaaatggcctaaaaatcattttgttctaaaatcatgaggtgatactaagtgaaaaatggaggaaagggcattctgggaataacatatcacaatcaaaattgtgcatagtcaccagttatctaagtgatattaggcactattctttttattatttctttcccttcttcatttgccatttaaatactcttgaccaggttggccactctgtgagcaagcatgttctttctagtactaatgagagacaaccattctggaactgaaaacctatcattctcaagctatgagccagaaatctaaatttcatgctaaaattcctgctgttaaacttccatattatccttccttatccagaggcccatccttagatatactagagtttgcagatcctttctttcttttattctttgattttttttttcttcagaaagtctctttttcttccctgtggcatgagcctcaatcccaaaggtatcatatggctttggtggcacagtcctgtgactgcttgataaaattctgtaagactggttaagagtttgcatttgctattattagtgagattaaatattttctaaaatgtttaaaacataaaaaaaaagaaaacaatagaactgagttcaaagtcccattctgcttcttattacctctatgagcttaggcaaattactgaacctttctgaatttcagttttttgaacttaaaaatgggttaatagcactcactttataaggttgttacaagtattatttcataccgcacatgaaatttgcaccctcattttagtttcctttcttctttctcttcttcccatgtccatcccctggcactggctttattcctttctagcttctcacaatcatgatttactgctttccttcttttctatagaatgtttttttcattctatccatgaaattatgtgcaagtagattgacctgcctttaacacccaattaattgaagaggtgcttatttctgtcaggaattcaaacacagcccccttgctgcagagcactggaatagttccctttgcttctcagcctcttcatccaggttcacttttaagtggaattgcagccatttttgtttactcttatttactctctttgctgtcccccaattcaaattcctaattcagagtctacttgatattctattactcatgataatttttggccaagtgttggttcaagacaactaattttgcttggcctgatcttagatggtaattattttttcagaatgatgataatggatagtaatcatgatctatttaccaaaatgaatcttactcaaaggttttgctgtgattatcaacactagagaaaacctggtgttgggattaacatgaccacttcagttcacaaagacaaatcagaattgtgtggaggaatcatgccggggcaggagagtgcaagtaaccatcttcattgatttttagcatattctgacagatggctgcagcttggtatgaggctaactgcccttgatggctttaggccaatgtgacaattaaatggagtctacagggttatttttacaaaagaagagccagggccattggcaaaggagattttggcaaggaatggaaacagaaatgaaacttatatgaccaatgtgtattactatacttccagagctagtttctatcttggggaaaaaagaatcatttggaggaaatactcattaatggtgattgcagtaatttatttatggaaaaataccctttaagtattaaccaataaatgtaagttctccagcagcagtaatatgtctttattatacagcactgctaaaatatacctaacatttataagtagtttttttctagaacatttgcaatggaaaaatagagactaaattttttccttcaataatgactggagaaaaaaaatctcaaaatgtacatatgcagtgcttagatccaacagtatctcaggctttaatcctttaacagcacggaggttagcaaaaatctatcttcagccacagatttaaagattctttttaagacaggaaaagacgctgtagaactaatctatgacctataaatcctgtttaaccaagctcaaccaagcttttcagcctacaccacatgatgggtgtggaatatgttaaatttacatcaaagagaatgctgtagtcttaaaatatgttttacatgttgagagtaaaatataagtctattgtgcttaggcagtgaagaacaatactttggagatcagtgtgatacagtctctagttactttggtggcagcattatttttaaacatgcttttcaactgactattctcagtttcatttcaaaataaaaccataggcaaacataatttgtttcattttatagggaaagaatgcttcaccataggtgagatgaaatctgattttaatatggagaagatttacttggcaatgcaaatgtgaatctaaaaatgttttagggaatttttaaaaatgagttgattgatgtaatatacgagtatagcaaacaaaaattaaattttagtgaaatctctgtacccatcattttgccctccctcaccatatacttatacacttccctataccgactatatttaaaacagagatgtatggttttgaacaagagagaacacaagttcttaacaacttcattcactgcaaagttacttatccagtgaatcataacaaatatttccattaccatgtcaagttaatagatacttgtctattttactaagagcatgaaatatatttaaagcagcagaaaataaatttcctgtcaattattcttattttctatcagggtgttaatgtgtatctgcacgtgtgtgtgtgtatgtgtgtatcaaaaagatgtgctactaagcatctccctttagaagaatccagctggttctgtattaactccataacacaaaaatgtttgtagctttcaaagcaaaagataagatctggttaagtcttgaggtctttgaaatatgtttgcaagaattgtgaaagtgtggtactgagtattttatttaaagaacaagaaagctcaaaaagaattgtcccctttggtgaacagataagcaaataaacagtaacatctgcttctctattttgtttaaaaaattggtgtgatatctgagggtattagaaagtatataatgcaaatactttaaatgaaaaacagttcattataaataatataatgaatttattttagtttcatcaaattttaacaaatacttattaagtgcctaccttaaaccaaacactcttctagttgctggggctacaacagagaacaaaacaaataaaaaccttgcctttaatgagcttacaatctagtagggggagagagcctttcccctaaaacattgatcttttttgaggttaataatattgcaagacttggggtctggctagatgggatatgggaaaacggggagaggagtcaaagatacctcttaggagtcttcctagtctgccatcacctctgttttagactgggtaatttataaacaacataaattgattgctgtcatttctagaggctgggaagtccaagatcaaggtgtcagcagattttggtgtctggtaagcacctgttcttcatatacagcacgttattgctttgtcctcatatgtcagaaggggccaacaggctcctgaagcctcttttataaggacactaattccactcatgaagacagaaccctcatggcctaatcaccctgccaaaagccctactttttaacatcaacatattggggattcgatttcaacatatgatttcttttttgagacaggatcttgccctgccacccgggctggagtgcagtggcacaatcatgacccactgcatcctcaacctcccgggctcaagggatcctcccacctcagcctgtggagtagctgggaccacaggtgcatgccaccatgctcagctaatgtttgtattttctgtagatatggggttttgccatgtttctcaggctagtctggaactcctgaactcaagcaatctgcttgtcttggcctcccaaagtgctgggattacaggcgtgagccaccacacatggccaacatatgaattttgaagggacacaaacattcagactatagcaacctccccacttcaactttcatgtagaaaccccttatctatgatctcataacactctgccaatatgtttatcacaacgccttatttcattgtatatttgccctcaaaaacttctatttacttgtctttgttcctcactgaaacttaagtaaagtgctatgccttttcttatgttgatccctcagtgcttggctcatatcgttcaacaaaatgcatggacagagtaagtgagcagagaactacagatagagtagatttctgaaatcaggaacagaagttaatggaagcagacagtgcatattattttggaaatattggaacacctacgtgagccatctagtttgaaatgttcagtatcaaaaaaagttgaaaatatggatctgagtccaaggaaaggaataaatagagaaaaaatattctcctactacttgcttactatgtgccaagtatttttccaagtaactgtcacatttattttaacttagtgttattaaaactaaggcttaaaaatgttgaacaacatgccacagggtcatcagttacgtgtagtggagtcagttaaaacccagcttcggccgggcatggttgctcatgcctataatcccagcactttgggaggctgaggcgggcggatcacaaggtcaagagatcaagaccatcctggccaatatggtgaaaccccgtctctactaaaaatacaaaaattagctaggcgtggtggcacacgcctgtattcccagctactccggaggctgaggctggagaatcgctggaacccgggaggcggaagttgcagtgagctgagatcatgctgctgcactccagcctaatgacagagtgagactccgtcaaaaaaaaaaaaaaaaaacaaaaaaaaaaacccaccagatatgtctgcttccagagctcatgatggacgtagataattaagactttcataggtaaatgtaataatagtaagtattgaaaaacctagatggagttttatgcaagactaaaagaaagccaaaaaccaaaccatggcaacacttatgtattaggagttcatagaggagaaaggccagcgtaggtgactgaaaagtaatcacggaagagaacaaacagaaggaaatttccaggaggtggtgatcatgattttcaaatatcacagaggaatcaaataaactatggatgagaagagaccattgactctatcaattataaattttaagcagccaatttctgtacagtagtgagattgaagccacataccacgttggatttgaagaattggtaagagctaagaaaatggaaacaaaaggtaaagtagggttttgaaatggggcagtagattgagagcagactgaatcagggcaaaactttcatgtgaattggaaggcaaaatacaagggaaactacattagtgaggaggtatacactagacatcaggatagtgctgtgagtgacaagaagaaacagacccagtcagagatcaagttgccttaatgataaagtatatagaaatatgcagtgataatcacataattcagaagaaaacaacatgatcccatacaacagtacaggcttcccaggttgccaagtcccaacaaggacatagagcttcggaatttttttttttttttttttttttttgagacggagtctctctctgtcgcccaggctggagtgcagtggcatgatctcggctcactgcaagctccgcctcccgggttcaagccattctcctacctcagcctcccaagtagctgggactacaggcacctgccaccacacctggctaattttttgtatttttagtagggacagggtttcaccatgttagccaggatggtctcgatctcctgacctcgtgatccgcccgcttcggccttccaaagtgctgggattacaggcgtgagccaccacgcctggccgagctggggatttattaatcctcacctttgggaggaggattaaaataaaataaaaagtttgcctttggtattctcacagtagaggtgatattacatcttcccactcttatctaaagttggttctcaaatatacatcatatttccgagggcaagcacctatcactggccaagacacaattagaactcgaactttttatctctatctggcatacaaaaaacactaggcggtcccttgttactgaagaagatacttaatagtgacatatgtatgcacagagcttgcattgacagcatagatgctaacatgactatttccaattcaaactatcaaaatatcaagtacaacatgatattagcttcataagtaaattgaatttcttctggcataaaatagtcacaatctgatatttttctcacctttcaactaaaatcattgtttttatctatgacagtctaatctttcaaattttgtcatttaccatagtgaatagtatcattaacttaggtaattttatggtaatgtgggtagttgtgttttagtagatacacttgtagctaaatactttttcttgtctgtcaaaatcaaaaggcttagctatttgataatgtactgtatatgtatgcatgtatgtttgtgtgcgtgcatataggcatgtgtacatatataagtatgcacgcataatttgctattgtccaaagtattttcactagttatctcatttcaaactgtaaaccctggaaagtagacataatagaaactatgcccaatttaatggtaaaataactgagtcttgggaaattttaataacacattcatgtggagcatgtgttattaaattattaaaatttcttggagcaagatttggtgttggaatgtaagtcctgtgcaaacaatccaatgctctttgcactataacaatttgtctctggtatataaagaactccacgccatctctttttgtctttcagtgaatatttatggttcggttaagtttccctgcctggagatataatctagtttttattctatttatattaaaatcttaaatgcccaggaaactggggcattctggttaattggatttggtggttagcttaaggttaaatagaactttttacaaattgccatccttgttgaaaatcattcttaaatatgaatctactttccatgttaatccaaatgatcataatttaatcttttataattgaaaatcttatagtacatcagggttgccatttaagcttgagttgttattgtaaagtgttctaggtataaagggatgttgtagagtggacaaaatgtctagtggtcccaggatatccgttgcaaatttttaatggccccgtgtgagtttttgaaaaagcactagatttacagttagaaatcttgagtccaagtccaatttcactattaaatagctatgtaaccttgatatccctttcttcttctcaacctcattttcctcaatagtcagatgaggaaatgaagctaaacgatattcgaggtcctttctggctttacaatctctgtcattctgtgacttgcttcttgtctcttgctcctccactgaaagaatcctgcttaattgagctttccagttagttggattctaattaattgcaagtttactaattccaggtgaggtccccaaacaagtgagatagatttaagttgagcagtcatgattctttctgaatttcctataggcaagaagaactgaagaagacaccacacttccctttctgtcaaagggtagtgatgatggcaggcaactatagttaaggaggcaacattaggccagtgcaagactagtctatgaagtcatttttcctgttacgcaataggtgcttgatacaattttgttaaataaatgcatttttaaaacaaaaccctttgtgaacccaaaatatctgagacacatctcagtcaatttaggaagtttattttgccaaggtcaaggatgcgctggtgacacagccttaggagaacctgacaacatgtgcccaaggtggttggggtgcagcttgcttttacacattttagggagacttaatacatcaatcaatacatgtatgatttacatcattggtttgatccggaggggtgggacaactcaaggtggggagcttccaggtcataggtagatttaaacattttctgtctggcaattagttgaaagaattattagtagaaaacaatgtctgggttacaataaggggttgtggagacttaggttttatcatgcagatgatgcctgctttagagaaaatagactgtatatgtttcttatcagacttaaggtctatgttgatgttaacactggagggatataacgaggcatgttaaactccatcttccatcatggcttgaattagattttcaggttaactctgaaatgcccttggccaagaggaggggtccattcggatgatttggggccttcgaattttatttttggtttgcacctttatagtgacaagattcaagatgcaacaccttgtatagaagtctactctgccttgggtcatactgtgtgtgaggctgcagtacagtttcaatatcttccttcatgttgtcattctcagtctatgacataaatacagcttcatattatgtttcctattgaaagataaaaatataatctggtttaggtttaagttacaaccagccatttctatactgcaccccgtgaatccgtgatgatatttgttttctaaggataggcaatgatgcatagaaaaaataagtccaggtttaatattatatttgccaagtacaaaagcatatttagaggtcagcagagtgcatgaaatccctatattcttgacgttgaccttaccttgtttatctctctgtgctgtccctgaataattaaagtgaaccaatgtgtttcttctttgcactctcaaatccacacagcagggaactagggagagaacattttagtggaaggcaggcctgctttccacaaattctcctgtgctcaagtggaattgtagtcactaagctttagagcatagcacaaagctgaatttgactgtttcttaagtgacctaacctaagaggagttaatgttgtttcaattgctatgattattatatattctgcatattttaatcagttcaggttttggatttttgcctcatgacaggttcatgaggggtacagtttaaaaagcaatttttttttattgttacaaagatttccttgtttggtcagtaagggtaaatgtttgaggcaattatcggtgagttgtatatgctctctggccctagggttcagggtatttgtttggataatagaccaatcccaagtgcaaatagagcatcaaggaggaacagctgtgagcttggggaggaagataagatcaggagtgcctggcatgaaaatcttcctctgggagtctttacagagtgacagattttctcctgtagagatgtagaatacctcaaaacttcacgttccaattggatgaagagtttagacaaatggttctcaacttcaccactattgacattttgggctgaataatttcttgttacatatgtcttaaggaggtagactgtcaggatgtttagcagcgtatctgacctctacccactagatgccagtagtacccctccccaagttgtgataaccaaaaatgtctactgacattgccaaatattccccatggaccagttggtcccctgttgagaaacactttttttgtagccagtttgagaaacattcttttccatcgatgtttcccaacttagtcctggtactggtaagacaaaatctattgttgctggatcactttttactcaaaccactcttcaaactcttaatttcttttttcccttcccatctttccctcctcctattcctttcttccaaggcctttgttagaggtttagacaattctccagtttatagtttgggatagaaaccattaaactacatccatttaaatctgagcctctctgcattgctttacttttaatgcaatggcaactcgtcatataatttttatccccaattaacttgtcatatcctgcatttctatgtgagagtcttaagcaagagaaatacatttttgacacattgaatatataccctgtttgtactatacttaattgacttgttttctggtaatgcataaagatggaaaaatacagtgtgtcattgctgactatttatttagatcaaaactaaacaacctatagcaaaggagaccagagtgacccctgaagcaactaacgaatgatcttctaaccttgcaaagacagccatatctatctgtaagatttcttttcttactctattcctttctcttctcttatactcttcattctccctatgttcactttttgtcctctatttcctgccttactttagacctgcactatttgggggcatgtcttagctcttctgatattgttctttgcaaaaagcttacaaggacacagaaacctgaaagaaaaatggcccatttggagatgcacataacataggatggctagaagtatagagggcattgtagacaatagcagtagtgaggctgacaggcctgcagaggccaggtcatgacggaccttataaaagtagtataccttcatttcaaaaatagaaagtacatggataatcaccaggaaaaataactacaatttccatcatccaaagatacttactattaagatttccttttgttttcttctagatcagatgtctgtggaatggggatttggggttgtattttgcttttggttttgtgtgggaggggacagcacgtaattgtggttgtactatatgcatgaactctgtttcttgctcaatatggaaaattatctagttactgggagcagaaaacctgtacaactaaattaaactttttaaaggttttttttaagatgcagagtaatctcacagtgaaagaaaagcacagtaagtacagccaggcctaatgaaagatgaaactctctccatcattctatttctttctgggaccaggtgatgtctcatcttttcttctctctagagatatgctccattctcaagcttcactctagatgggatttctttgtctgttcccctataatgttgtaactccagctctggctcaacatgaccttgcatcttggcttccccagttgtgtgtctatgtctagatttctgagtgagaaagagagaatacgattgcctctaagtttggttatccaattctggactatggctgcaggcagtggggagtgggcatagggggatcatggatgtcctgtctaggtctctgtgctgagagacaatgatctacatatctaatatgcttatgtggttaccaattctttggattttctgactgcataatattccatggaatgaatgtgttaccagtagaagagatctgagttaccctgaccagcagcatatccatatgggtccgtagcaacttcagtccctgcctcctcagaagaaagaatttaactgaggggcataaagcagaaaaagagactgaggcaagtttcagagcaggagtggaagtttattttaaaagtcttcaggacggaaagaaaggaaaatttgcttggaggagactcaagggggcacctgaaggtccaagggagaaaagagagcaaaaaaaaaggtgcctttaactttgatcctagggctttataggctcgtctctcccatgattctacccttagggtgggcttcctgcatactcagtgcgttccttaccatttggaattgagcacgcacagtgtgtttagggagttatacacatgcccatctgaggctttctttccttttccagtggcgtgtacccggaagatcatacttcgctatttttgtctcttgatgtgcatgtccaggaagttgcttctccttggggcctacattcaattaacattttgatgttaacaggtgtggactatcaggaaatggcaccggctaccaatttgtcactgtttgaaaggcaatgcaataattgctgaaccatcaatggacatttctagtgggtgatagggagagccctctcctgccccactcatgcctatttacctgtaacaattgtactaggctccttccatatttgggtctgcttttttctagccagtggatgaggaaggagattggggatcatgggtggaaagttttaggggtcaagccttgaagtgtcagacatcacttttgctcacactttacatttcattagccagaactcagtcgcaggaccacacctaacaaaaatggtggttgggaaattgtactccatttgtgtgcccaggaagagaggagaacatgggtgttggtgagaagcagtctctgcttctggctgttttattttgaggctatttcaaaggacattcatgtgttttgccagcttgttctttagagaagaaaaatgttatgctggatagattaagggactgatttgagtggcatttcttatgttaatttatgacattataaaatattcttacctttaatgtacatgtatgaataagtctttcaaagaaataaaagctgataaaagccaaatgttgatcaagatccttcaaaagttgcattagcataatgatctagattttcaacctgaagtgtttagtgagaaactcttaggctctgtccttcttgtacttctttgtaattaatttgaaacttttttttatataagatgtccttatcgaggtacattataactcaataaaaataaatgatacagaaaagtataccatgtcaactggctcataaaataaaccaggaaaagacatgtctgtggaaaatgaagttgaacgggagtctgaggcaggagaaacgcttgaacccgggaggtggaggttgcagtgagccgagatcacgcctttgcaccgagcctgggcaacaagagtgaaaactgtgtctcaaaaagaaagaaagaagaaagaaaagaaaagaaaaggaaaagaaaagaaaaggaaaaaaaaagaaaagagaagatgaaaaaagaggtaataaaagtgtataatactctgcccactaccccctcctgtataaagaaaaaaataaccataataatccaagtaaccactgaagatcaattttataaaatcatcagtttctctgttgagtaaaattgggaactgactttcagcaaagggaaatgtaattgagtttctttacaaaatgaagagttttttttttttttaagtcctaggaaatttagagtctgatttacttttaaatgtatagtcacaagtatttcctgcgtcacctgtttgttcctattttgattagtctctgttagggaatgaactactgaaaactatagggtggcattccattattcctccatagggaaaatgtataaaattgtaagaggattgataagctcacctaccaatagctttccacattattttgtagtttgaaaggattatagcttccacaccattatctcaaaacctaaattagcattaaatataaagagaatgaaaatatgataagcttacttatctaagtaaataatttttatacgttggcctgagccttttaatacaggaacatttgcattaatagaaaatattaatttggtatttactcttcaactgatatagagttttttaatatcaaattttaaattaaagttgggttaacagaacatggatctaacttggggaaggagaatgaaagggtgacttgaaagggcattattatgaagagaagcattaattatttattttaattagttttgaggtctactaaagcaacttgatcaaacattgtaaaatatgtagtatattctttctataccatttatgtatctatgcccttactcctactttcaatttatctctaaacatcctgttaaagaatgttgaatttatatttagttatatttaatttatatttatgtttatattaattgacatgggaaagtccagtacagtactgcatgaaacttttctgatgtcccccacattctaagcagggagccatgacaattacctcactttcacaatgatgataagtatcctcctgatatcatttgatcatttctgtaattttaagagttgaaaacaaattccataaaaacatattcagtgaaatatgaagtttatatgtattcatctttgagaagagaaatatcagatgaccaggtgaattaagaagatcatactacctcaatgattaatattatgagtgatattgtaggcatggattttaaaatattattgagtgcctgctgtttattatgcaccattttaagcactgaagatacagtaataaataagataggcatttgtactttcatgtagcttacattctagcaatcaacaaaactgaagttgattaccaactctgccttttaccaattgtgtaacctgatgaaatgtatctaatcctattatctgacccacagcctcctcacctatgaaatgcagataatatcatctaccttataggattatggtgaggattcagtgagaaaaagcacatgaagtactttagcagagtacctggcacataatagatgttcagtaagtggacaatgatgttgccattatcattaacagcaattatctttaaattattagtataattattaatagtaattctttcatgactaaaatatctcacaagaagacatgaaatgtgaatcaactatttctttgatttatttattttagattatgtgaaaatgaaatgagcgcatatagttgtttttacattcaacaagccaagaaatatttgcccgcaaatagaacacttaccttagactacccaacctttgttccttctgcatagtgattcaagacccatttagaagaaacaaaggcatcatacaaatcaatatgtattcatcgaatacctctgaagtaagagacaatgtacctagaaattaagactgtttcctgtcctcaaggaatatgcaatccagagatagttgaccagatagggcagatattgcttctgaataaaagaggagaagggatgataaccactgaaaggtttaaaaaggatctcccggctgggcatggtggctcacgcctgtaatcccagcactttgggaggccgaagcaggcagatcacctgagggtgggagttcgagaacagcctgaccaacatggagaaaccccatctccaccaaaaatacaaaattagccgggcatggtgccacatgcctgtaatcccagctactggggaggctgaggcaggagaattgcttgaacccaggaggcggaggttgcagtgagccgagatcacgccattacactccagcctgggcaacaagagcaaaactccatctcaaaaaaaaaaaaaattttttttgcaaatcacgatagtaacgatctagactacagagtatttctatttgagaatatattatagaactaagacttaagcctaggaaaattaaagcttagataggtatccagaaattcatttaaaagctcttaaaattatgaacgatgtggacggagcatggaatttttatcaacacttggcgtccgaggtttagaagcaatatgtggacagaggtggcttagtatttggaagaaagaatcacagggcaaataaaatgaaattctcctttatatagttgttagtagagatgttgaggttgatatctttgccagtaatgactcttttccacaaaacaactctaagtattcttgttagagaagaaaatggggctgacccagcatggcattttcttgtgttttttggaggcatgagaataaatacctatgaatagccatttaagcaaaagtgatatacaaatgccaaaaagcatatgaaaagatgttcaagggcgggtgcggtgtctcacgcctgtcatcccaacactttgggaggccgaggtgggcagatcacttgaggtcaggagttcaagaccaccctggccaacatggtgaaaccccgtctctactaaaaatacaaaaattagctgggcatggtggcaagcgcctgtagtcccagctactcaggagtctgaagcaggagaatcacctgaacgtgggaggcagaggttgcagtgaaccgagattgtgccactgcactccagcctgggtgacagaacaaaactctgtctccaaaaaaacaaaaaagaaaaagaaaagaaaagaaaagatgttcaaaatccctattcatcagagacatgcaaatcaaaaccacaatgagatatcacctcacacccatgagaatcattactattaaaaaaaaagaagaaggaaaattacaagtattggtgaggatgtggagaaattggaacccttgtacatggttggtggtgttgtaaagtagaaaccgctatggaaaacggtatggaagttcctccgaaaagtaaaaatagaactactgtatgatccagcaatcctacttctaggtatttatccaaaataaatgaaagcagatctcaaagagatatttgcacaccttctatgtttacagaagcactattcacaatagccaacaggtggaagcaacctaagtgtccatcagtggatgaatagataaacaaaatatggtacatacatacaaaagaatattatttggcctaaaaatgagggaaatcctgtcaaatgctacaacatggatgaacttggaggacgttatgttaagtgaaataaatcacaaaaacacaaatactgtatgattccccttatatgaagtatgtaaagtagtcaaaatcatagaaacaaatagaatggtggttgcttggaagaggatggaaagaacaattgtttaatggggatatagtgtttcagatttgcaaggtgtaaaagttccagagatctgttctataaccatgtcaataatacttaacattactgaactatacactaaaaaaatttaacatgcgaaattttatgccatatgctttttatcacaataaaaattcattttataatttgtttttttaaaaaaatacctaaattctactatgctatccaaatatggtttggtcctattaacttctagtcttcttgtttttaaaaacccaacctcagcttctactggaagcaagttgaattccttcttctgggtacaaaaatgagtcagatgcttatagctaagggaatataggtatagatatgcgtctcataagaatgtttacaagatgtaaaagaaaaaaatcattggttatttatgcatctgttgttagaaagtcatagatttctgtctgtttcctatagaattttaagtgccacattaaatcacattatttagtgctagcagataccctcagaattatgtagtatgaggggtttaaaaatagagagcacattttccccttttttatagatgattttaaaatccttacaggggcatttattatattcccatttaccaccactgggtctcatcattcttgaagattttttttttaatttctttatatgcccatttccttttggtaatatcttgcctttcctttttaaatttgaacttgaatattaaaacagatgcaaagaagagtactacttacacataaactcttgaactgcatttttatcatttgctctgtggaaaaaaacccaattgtatgaaattgatagcaacattttagtatatcctcaggtccccagggaaaagcaatgtgcttagacagatgatctgattgtatgagcacatagctaacatctagcactgagcatttgtctttctgctcctgcttctttcagggactatgaaaacacatttaggcactagtttgactttccaacaatggactgcaaagcctatgacaaaacacgtcatttgcattgctctttttcatggttcacaacaaagtacagatcactttcagcatagaatcttaatctgagtttgttaataagaaaacaagaaccttagtacatgaactcattttattatctaccctcattgagaaccgtgatttggattccactcaaataaaaattagtttaaatgttgttctgctgcaactgttgaatttattcattatgctgtaatattttacttatgaaactgcatttggaaatcctttggtgtacatcaggatgaaattacagggctcagggatattgattattcttgtaattgccgtcataatagccaacaattctctgtcttttgttttccttccttccacctcttaatattataccaaaccaaatcaatatccaacatattggaacacttacattgtctcaaaaatccaattattctccttcataaatgtgcaaaagattgaagattttatctccaaacattaagtaaaggaacctcattctgctgggtttctcctttgtcccataggaccatatcagagtgttgctgcatcgaatccataatatgtgacattttgtcacctccaaagtaaccacagggcaggagtggggaggtagggaggctacatccctacgctgcctgtatagtgctacacttcttgctcactagtaaatgaaatggtcaaaggggaaaaaaacagtctgggagagttaagcagacattaaaaaagaaattcatctttttatggtgcggaggaggttatttatttaaaagccttaaagtaacagcacaatcaaatgaaaagaggacaactaagagtcacttattcattaaaatatacttaatcttattattatttttatattgtttcttcattctggggataaattaggtgcctttagaagcagtagtaactcttttaggttttcatcaactaaagggtagtttctttgtaatgcttacccattcatccaaaatagttaagacagtctttaaaatttactagaagaacatttgacatacagaagaatagatgtgtattatgtagtactgtttgaacagatagtatttgttgggcccaggtcagttaacccagatgattagaacctgatgctaatctggtgaagactgtggttgtcaagtagcatggggtaatgtaaatacactattttggaagccccagatttcagtttcatccatgcctattagctagctatgttatttttaagtaagaaagtttcattctcttggcctcagtttccctaacgtcaaaatgagagggatgggctactagatgatttctgcgggtcccttccaactctgtgattctgtagccatcattctcacattcttgttattagtcagaaaaggaatgtaatagtgtggctcagttaaacatcatcctcatgccaaattcaacacaaagcatacttattctatgcctcaacaggcctgtattcccatcacaaacaatacactatgttatagtatattgtttaagagcagtggctctgcagccagactgcctgggtttgaaactcagtttaatcaattactagctgtggggccaaggaaaagtgacttaacctctctgtgcttagatcgtctcatctgtaaaatagagatatcgactgtaataaagttgttatgaagattaaataatataatactttgtgaagtatttagagcaatgcctgtcaaaaataatcactcaaatgttatctcttactaacattattataataattactattatcaccgctctactcctactaaacctctttgggtctcagttcagtcatctagaagattaggataatagtatcaacttcacagacatataaggatcaaaattggagacaaagtgcctaacttggagcctggcccatctaggcgctcaataaatcacgttaacttaaatggaaccaactattcctgtggttggtgttatcctgtaaatgttttccactccctaatactcatgaatctttttttttatcttagttacaaaatcaatacaagctcaaggcagaaaagttcagaaaatacccctaccatacaaaggtaacataaattattattttccttgaacatatgtactttttttcctttaaaaattgaataacgttgcccatactcttttgaagcctgcctttttttgcttggtaatatctgtaaacacttttcccagtgaatagacagtcatttgccacgcaatttgtaatgattgtgtagtactacattatgtgtttataaaataatttacttaatgaaatagcaattactgggcatttagatgtttattttttgctattataaataacattgcaatgaatggcttcttatatggattgtcatacacatcatttcctgaggaaaaattcctatagccataattattgcatcaaagaataggcatttttaaagtcatttgatacataatgccaaattgccctccagaaagacctgtgaatctgtactcccctcagcaacccagtcctttaaaaaatttttaacctcatgatactgaagcaaaattctctgttgtgggtattttccattaacattcatatagggtttttttaatccctttaaatacatatgcttttgttctttaaatatggaagctagaagtcagtcttaaaataatgttagtaatttatgcatttgtgcacacattacatgtacaaggtgatgttggctttatgcttagtgaaattttttgttgtacattaaaatgtagcactcgaatgtgttttgttattttactgccccaggtaatacggtagactgcttaagattaaagactttggtcaaggtgatgaatatgctaattatcctgatctgctcattctacatgtatatgtattgaaacaacactatgtgatgctggtaggctgggggaagtccccaaatgctggcgggatcttggccacagctggtgtccaggctcttgacactgttgcaagaatgaactcaaagacaagttggaaaatagtggaagtatggacatttattgcaaagggaaatgtacacactcaagaaaagggagtataagtgtactcaagagagaatcacccacaagggggtttggagctgctaccttttggggtttgtttattcaaggggtagaatattcatgaaaattcctgtaaaaaggtggagatttatcggaactgtggtgccacccatttttacaccaaacatgggtatttctggaactgtcatggtgctggtgggttgcgtgatttagtatgttaatgaggatataatgaagtccgaggtgaaacctaggtcaaatcccgcaccacgttgggtccagtcagtcttagccagcttggttcaaatcctattattcagggtcttaatagcccatagcctctaatcatgtgaaactgctgcctggaatttttttattctcctgcaaccacactatattattcctgtctcatatgtaccccataaatatgcacaattgttatatatgtcaattaaagataaaaaagaaaagaaaaaagtttataaaaaatgattggccaggcacagtggctcatgcctgtaatcctagcactttaggaggctgaggtaggcggattgcctgagctcaggagttcaagaccagcctgggcaacatggtgaaaccccgtctctactaaaatacaaaaaattagccaggcagggcggcagcctgtggtctcagctacttgcgaggctgaggcaggagaattgcttgaacccaggaggtggaagttacagtgagctggagttacaggctggagtgcagtgagatctggaagttacaggctggagtgcagtgaatgagatcgtgccactgtactacagcctgggtgacagcgagactccgtctcaaaaaaaaaaaaaaaaaaaaagattaaggactttggaaccccaaatgacctagattctgattctggctctgtccttcacttgctaggtgagtttgggcaagttgtttaacctcttttggtctccatttctataaatacacaatgagaataatatagactatttcataagagtaaagagcaaaagagatactaatgagtgttcagcacaacacttggcacttagcaagtataaaagtacttttatttatttgttgtataaaagaagtatatgcaattttatttatttatttatttgtttttggcaactccttccatgtgaatacattactactgtttacaaaatgcccatattacaatagtcatgaacactcaacaatcattctttagtaattcaaacatgacagtagcatgactccatttgcatgaagttctacaagaggcaaaacaaatgtatggtggcaaaaacatgcagaatagtggttttctctgggaatagaaatagggatttacctagaaaagacagaagagaacttcttgtcttgatgggaatgttatacatcttgataggggtttgggttgcataggtgacagcatttgtcaaatctacagcaaatgtgcacataaaactgcacattttattatgcataaattttacattaaaatttgtaaaactatcaaactagctaataatatgtgagttaaaatatatgaagggaagtgtactgatgtatgcaacatacttcaaaatgcttaaaaactaaaaactggccgggcacagcggctcacgcctgtaatcccagcactttgggaggctaggcgggcggaccactaggtcaagagatggataccatcctggccgacatggtgaaaccccatctctactaaaaatacaaaaagtagctgggcgtggtggtgcgaactgtagtcccagctactcaggaggctgaggtagaagaattgcttgaacccgggagatggaggttgcagtgagccgagatcatgccattgcactccatcctggtgacagagcgagattccatctcagaacaaaaccaaacaaacaaacaaacaaacagaaacagaaacaaaacaaaacaaaaaactaaaaactgacagatggagagaagaatggagaaatgaataagtatgtgacaaagtgagttcagtcaaatgctaactgtggaatctagttagtgagtatgtgattgtttattataaaattctttcaacttggctgtatatttgataatttttataataaaatgttgaatgaaaatatggctgtgaagctagtctctaaagtttggtagtgaggataatctcaaacactggtgtctaggccattctaatgatcaaaatgcctaatgatgcatctctgtttttgaatcaactcttgatgatcatatttaatgaaagggaagggtgtagtgtgtaacaccaaatgtggaatgttagcactcactagccagcaaatcggggaacacaaggcctgtttcttaaaggtctagatgaaaaaagaaaaaaaaagacaaagaaaagagagagaacaacaagggcaatttagaattatctcttaggtatatgaaaatgttgctgagctccatccagttctcttgagcttggctatagcatgattgtttgaaattaatggagtttgtgtttttgtagcaactggctttgctttttatagcccaaacttgtgtttccttttcacaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattggtaagtcctttttgtcatgcctcagttttgttcttaatcaaagtcttgttttgcttgtggtgggaatggggggtttttctctcgattctggcatgtacacatttggacctaggcttagtatgataacaaattgattttcttcttttttttttttcttcctaaccttaaatactgctgaggagagtaaggaatgctctttgagaagaaatatttatactactaacacagtcttattgatcgcaattactgtagttaaccattttcccttcaattaaaaggttgttatggttttcccattagaagtcataagtaccaatctacaatagcttcttaaattacagttaaacaataatactgctacggaattttcaggtagcaatttcattaaagccccagttatttggaagctatcagaaaattcagtacataatttcttcccaagaattcagatttttacactgtgaccaaaaaatgtattcttatttcactaggtaaatgactgcaaaattgtttagttactatgtcttgaaaagtaaagcagagagcagttataaggtgctctttccacttttaggaaaaatgttgttgttcttgagtcaccctgattaaagtcaccctcatttggtagcaaattgtattgatttttctggatgtcattttattgtgactgaatattaatttactttcttgagtggttctgcagtctaaaatgtaaactgacttaagaaatgtgtgtattttgtggcagcactattcctagaaggaatagaatgtcattgtagaaaacaaagtctatccaagtatatccctaataaattattttcaggtttaccccagttacctatttgaagcagatttacccactaagagacaatgaatatgattttgagtggcagataaaaagagacttagactttctttaagtaataaagtacatttggttgattcccatttatctaaaatgagaataatctaaaagttcacataatgagtttgtgtgggcatcatagaccagtggatggtaagtaaataaacggctatattttgtagggaggtcactgatgatgtaaacagtataggatcatagcctgcgctgatgttcatgattctctcttttatattttcatcacacaagctgaatatatttgaacaatgcttctatttaacatggattatattaccctataatatcaaaactgtgtcttttatctcagacatttcaggataacccaacatgtgtgtttatttggtttgtggtgacctgtaatgagaaatactgctgaaggaatggaggcgaaggatgagaaagttctacaactcaaacatgattttcatatatcattgagaacaaggaataatataaaaagtttaaatacattagagtccctttaaaatggtcttgctcaattgagataaacttttatatgggttattttctattaacttttactatatagagagataatgttttagatacaaggcctaacccttggtgtaaacaagctcaagtaatagcaagctctttatttaggtttataccatgtttaatactaattttctatttaaatttattattatggccactcccatatcaaaattttattacatattctgaaacttgtttaattcagttgtatgtttattcatttcatcagcaaaagtggaacatttcagttatttcaaggactgtcttttttaatagaataaacaatggcatatcaatttggcatggaagtaagacagtatagttcaatagttattaacatagatttttcagacctctgccacttattaggtgtgtttccttgggtgagttacttaaccttttcaggtctccatttcctcatctgtaaaacaggcttaaaatcgtacctatagcataggattgttagaagaattaaatgagttaatataagtaaagcacatggagtagtgcctgaaatatagtaagtagcctataaatgttaaatattatcattaatattaccattgttaccatcataattattattcacgattaaaattcactagttcccagaattaacaattttgttcatggctgtatctcagcaccaagaacagtgcctggcacgtgtaagccctttcagtaaaagtttgttggaaaaaaatgaattatgctaagctctttccttgtatgagcacatttaattctcacaacaatccttaaggataggtatcaatacatatgtattttataaatggggaaactgaggctcaacaaagttaagaggtcacatagaggccacttttgagattaagagggtgccttgctaagaaataaggatgctgagcttcaagccagagcagactgactcttgagtgctaggccttgctgctcttctagcactgaagtaaactttataacttgtttacttctcagtctactgaataaatccaccagatattttttcttattaaattacaaattcaattagatataccaagtcatctattcccatggtgagtgccactaagattggttgattggtaagcaatatttgttgaaatcatttactgggagattttttagatgcagaaatatcaggctaaatgctggcacagtaacttgagtgggttcaatatgagaagatgtttatggcaaacactggaactttgttcctggttctgtcatgaactggacattatgtgactggataagtcagtaaaaatctctcttgatttatcccatctgtgccatattggtgaccacctcagaaggatagagtaaaaattcataaataggcattcaggtgaaagatagcacataagagctgtaatatacaagatgatttttaaatggctttctgtggttgaaataaaaaagtattatatttcaaaatatgaaaccatttcattctcgactattgctgagtctgtaagtcatcatttttttcaatccccatttgcagttgctgtataacccaagtaaaatctttcactgaaactacttgctgcttctgtttcccatgcaaattcctttctgctatttcattttcctctattatccattatacataacctttagatactaatggctgtatgctgtgctgccctcaatccactaggggaaatcgcatcgatatcaatgggacatcaatagtcattctgtgcattatagctctgtaagtggtcattggaaagcagtggaaatccagcacgtgaaaagccagagctgggttgttcagccaaccagtcctatctccacacctacccactataccttttggatcagggaaaaaaatcattcctttgaataagttttgagttcaaaaaagttggtgaagagaggcatggaaaaatactgattatatgaagatagcatggaatggctattgtcatcacttcctcgtaaatctgtaatattttccatctgaatcaaaaagtatgtccttatgcttcatcttttctgatattttggcatcagtgatgtatcagtgccagtcagaagcacatttgcttgaatttacaaataagccatatgaagtagtagtcaggaagacagatgaccatatgcaaggtgtcaagagaaggcgaggttaaggtacttcatcagtggttgtgaagggcacaaacacagcttctctggcaatctttgatgttttgatcaagtttcttcacagtcagcagattgtataagaggctacagaatctcacatacatggaaactcacatgaatacattgtgcctggggtcaagtgcgctgttacattgaatgagctgaagagtaggggtttctggctctcgtacccattatcattagttaatgacatggatgatccttttcctttgccatgagattagtagcaatccataccaccttcaggggatacaggtagtattccaactgtgcagatgaaataatttcagtccataaatcttgtcatgacatactatatagcctacatgtagaaagctgaccacaatggatattaacaatatagaactagaagagatagagttttgtacccagttctctgatccaaaggttagagatgaaactattcaagagggcaaagggccttcttcatgttgctctctgcagcaaaattcaataacatagattcaagtgctttttttgcctctttgcactggcccaaattgccctattttgggggtttactacagtggagtaaaagagtgctgaaaataatagaatgaaaggagtggtgtgtgttcattttgtccgcctcaaaaagaaagtgcaaatacctcactatacagggaagacataaagtggactgtggcatgtgctgactttggaaaattcaagaatttagattttttttaacagagaggatagaaatggagttttttccccattaaatctaaatataaaaatgctccctcacacagtatttgctaaatgtagataaatatgcttaccaaagcccaactctttcacttatagtgctagcaacttcattaatctttctgtgcctacgtttcctcatctataaaatgggaatgttgataatactttcttcaaggattgtctttataattaaatgagttgaagcttgtaaaacactcaggacattgcttagcacagctgaataaagattaatgataattattagtgaaatagaattattatgaagattatttagtttgagctggggtaagggtaatgaggatataattcatcctaacatgaactgcttttgtttcccttctttccaaagtcatctaaaacaatttttcagagcatgaatgtctgtctcacaagaatcctctaatgagtttgttgtttccttctgcctggtctgaaatagctgtcactttgcctttattttactaatatccctcttctatgatgttttgacccttcaaatggttttgtatttttatctgaaggccatatctaggttgaaacacgttttcattaaaatgcattacagcttataacattcaagaaatgactcagcataaaatgctaaaaagcatttcacattatcctatagaccgttatcaatccttttgctgtcatgcttaatacttattacttcttccaattcactcttatagacccaatcatgataatactgacagtttttatattagcattgacttttcctcctattcatgaatctaccaaccttctagcaatgtctctaagcagggatctggaaaatggtggtatgacttcagtctaattacaaatctgctatccatgcatttaccagaacctttctttaaaaaagatttatagactcttcttacatcaccttttggtataatatattccataagttttatccccaccatgttaagtggcactcttgcctgtcataaataaaagtataaatccaatccaaattaaacatactaaaatgacatgatgaatccatgtcaaataaaactaatttctagaatcagagttaggtcctgttgttcagactaagggcatcttggtgaaaggcaaatactgcacttatttttttttcttagaactccagaatgtatttaagacacagagtaagagaaataatttattgggtgaacaagtagtagatactaaatatatgtcttgcatcaagagattattgtctcaaggagaggcaatcactctactaagtacttctcatacagtactttcttagcccggctaggaaaattaaaatgagactctgtgaaatagataaagatctactggtaggcataataaagggggactggacaggaggttagtcattttggagttttgcatgcttaagacattttagaacagtaagaatcaatcatgcaaactcagaccaaaaaaaaaatctctcaagaaatctatgacttcacagtaaataacttgaattctatttcataaagaagaaatttagctcctgtttaactcagtttctctccacccaaattgtatatatagtgcatacatagatatgtgaatattttagagccacattgcataagtcgttaagctatacttactctgaagtgaataagaataaactaaattagagcaatggcttttaaacagatggcaggttaacccattttaaacttcagaaatatgactaaatttttatctagaacagccagagtggggagggccagtatcaccaacaaaatatctgatttatcatagtcaacactaacaggtggcatcttacagggtggaggcttatccatttagggttcagcaatatttgcttcacagaaaggttgaaaagcatagtatgttttaataaatacaaatatattgcaatacctggggaagcaaaaaaggaaagatacagaaaggtggcaggaaatgaagacggtaagcaggagctgattatggaaggcattttaagccatggtaaggaccttgaaatttattcccagaacaaatggagagttgttgtggtttttcattagggcaagacaattatttgctcagacttacatttagaaaaatcaccctaatggcagtattgaagttgggtttggcaggcaggacgatgggtttgtaaaattgaaaacatggagataaattagaagactatattagtaatacagattagtgatagtgagagcataaacttctggtaatggagaaggaggagatggaatggagaaatatttaaatgataaaactcacttgacttagtgactaataagatgtatcaggagagaatgttgttatctggcttagggactgggtagatggtgatgctattagtcaagatagatagcaaatggaaggaagaggcttaagggtgaaaatggacctacaggtagagatacctagaacattattaaatatttggtgctgaaactttggaggtaactaccgttgaggacaccaaaatcgtaggagtaggaaggaaaaaggagtatgaagacttgaactctgggaaatactggtgttcaagaagcccagggaaaaggaatctgctaagcagactatgaagaaacaactagaaagattggaagaaaacattctatggtgaagataaaatagtggttctcaatgtgaggtctagcaaccactaggaattccaagacctgtcaaagcatctataaagtaaaactattttcataataccataaaagtgttatttatctcttttactgtaattctctcaggagtgtacagtgtagtttttcagagaccacatgacatgtgaaatcacaagaatttacatgcaaaagtagctatgagagtccgcctgtttttcgttaagccaaacatgaaagagaacttcaaaaatgtaaaacaatgccactattctcactaattttttgggttttgcaaaatactatataattatttattacaaaatgtgtcatttatgttaaaatgtaatggtatctatatattattcaataaattaataaatacttaaaaattatccattttaatttctaatgtagatataactcatgtcaccaaaagctctttggcatcttcagtaatttttaagggcaataaagaagtactaagactaagtcatttgttcatggaaggctagattcttgtctaggtatgatcccacaaagtagtctttcctgggtagacttacaagcccattaacaaattacaccaaagtacagatagcatttaaataatagcactagtttgtattgcatcctccatacaggcaagacccacgtggaatttcagattacagtgtaacttctcaggaacaccttccttggggctcctactcctctctatgggacagtaatgaacaaattaagaggatccaagatggctcactgtaattttctactcgtcaaagcctcatcaaagcgttgccagtctaattaacatagaccttgtgtactgtgttatagttaacttccagggtaattgcttagtcaagagtttctaaggaagggcctcacaaatgtttgattattgggttggatgtgacaatgggaaattcttaacaggaagaaaagatatatgatctggcactttgaaaagcactcttgcttctatttcatttagctcatattaaaggagctttcctgatcaaatgatcagggaactgtaggctagcatatatacatagaataccagaggaggtggttgagctctcagataaactagctgcagctctggtcaaaaatgaatggaaatgtgatttttgactgcaaccattctgtgctacacagacaaagactttgctctttggtagtcataggtttcattaaatcaaatagcccattattcaacgttcttaattcagttttaccctttgttcacttatgaatctacatttcctttggttttgaactttaattttaattaagcgtagatattaaatatggcaaataacaataatgcagtcttttatatatatcatatccacaaatactttgcagaattaactaataaaattatggagttaaatgaaaataatattaaataaagagagcagataaaagattttggattttactcataacaagcagctaagccaatactagttgtacaatgcttaagagagagaggagagagagagagagataccagctgtcaagaaactaggaacaagtatattgcactatgaaagaaagtggaaatttttgaaatggagtggttttgttaaagatcatgtgctacctccagacatagaaacctattgaaccctaatcctctgaagctaacaaatagttcactggtttttgtaccacctagcagagagtcaagaagtttttctttttaaatgtctgattgtagtggtaaatctagcctcaatcagtcgataagtagttgaagaatcagatgacttttgaacctacttgaactatttggctctttagaggtgaaagttcttataccagtgggaaaatgtaaaggactggaaatattcaatgctactccaggctataatagcacatgctccaatattatctcatagaatgttgtagagatagcactacttaagatttaccaacataggagactgtgggagtattgaaagccagatggtacaaatagatcctttctttgtcatgcctaaaacacagcctgttctaagattgtacaaaacccaaacaaaccattagtatctttggtttcttttcctgcctctgtatgtttttagtttggtttctctgaacaaattctgccattatataacttgggttagccatcatataaatctttttgctgataggcaacaatctagtcttttgaatcaatgaactattaaatgtataacccattaactggaaggaaaaaaaaaatccctcaattttaaaaataagaggttcaatgggcaatcacagttaaatagactttcaaaaaatgaagactgtggagtccagtggtagggacatattttggcctaaaagaagcataattcattgttagcatgcatagcaaattaaagaatatagttcttttttataggcaattacagtgcatatgtcttttgtgatttgagtaggtaggaaagaaataaaaatatttggattactcactgactgcctcagtagcattctcgctaatgaggctgaggtcatgggctcagttactatttcaatctgtcagttcagttctgttctgtttcattaccaaagcccatagtctcaatctccctttgcgtttccctccccaaatcaggaacttagtcctgtcttctacttcctaacaaaacctgaattcagaattgaatcttaggtcaagaggttttacataaaatgtcttgtttctctttaaaaatagatctgtcatccctggcccggcattctcccatttccccatgcatttattgagtacctactatgtgtcaagtattatttcagtctttgttgtggcaaaaatagtatgagaaccatcaactggggctaaataggaccatgaacgctccagtccatcgaatacccatcctaccctcttcactcttttatattatctgccttccttctatgtagatatctaagcctgaagccacataataaaataactcacactgaggtataaatggctataacaaagataagtgtattatatctccgttacgtaatttgcactttatcaggagacaaagtgttaattctaaaaaagtctaggttctgcaattagagtcaactcagaagttgaaatatatttgccatcactactttaagccaaagaagtgagatactcactatgaatttccaagccttaaaaatccaggtggagaaattatgtgaagggcaggaaaacatgcctaagaatacaacacagtcaccctgttagtacacctggatttatccacagttacaaatcatggccctaaccatggatgactctctcatagatgcatggaactgaacgtaaagaacagcatgcagtaaaattatatttcatacccattattagagacttgtttcaaatgaatgtgttatagatactgggtacacaatgttcaggtatgtgtgtctgcatatgtattatataaacgtaaaaataaatattaacagtgagttctgggttcccatagggtaacattggccttttaaatccaaatctctccattcccttattcaaaaagaaattcaaatgcagaagggaagcaagtaaaaccacctgtaacccactcaataacataaataggagatagataattctacaaacttcagattacacataggtagagaaataagcacccaaattactcagagttgtctctgtagcccatgccaggactgagagtcagatagaggctaaatggaaaagaagacatgagagctagggcccagctatggcagacttgatcaaattactcccattaaaaagaagaattactcccattaaaaaactgtttgaacaatctcagacctggcatatgagagcaatggctactgaaaatggaaaggaatgtactttaaagttcacagaagtaaagttggtagccttgggaaggcacaacctctgagggcatgggggcattaacttggaagagatgtcctttggaggcttggtggtgaagagaaagaagaaagcaagaggtataatttcaggatacagcaaaaataaaagtgaatcacaaaattaagcgacctaccaaaccccctatccaaaagccattattgattttaaaagctacactttaataagaactaataattctagtaatctaacaagtcaccaaactcctgattcctatttacatacaactcctattactggtccaggaaactaaaatatttcagaatgaacataaaagggagacaacacctacacaaagctctataagaaggaactagaaaataagaattaatcatttcatttgattaaaaaaaaaacttctaatagccaaccccaaagcagaaaaaaacagcaataaaacatctcagtcctaataagccttaaacaaacatttgaagatatgaaaaaggctcaaatgataaagtttaaaactcagaacagaaatgtacaaaatgagagttgactaaactcagggaataaattgaagaaaaagataaacccatcgtgaaaatgaatactatactgactgatgacgaagggagaaaagatattaaaatgaaaaagatgcaatgatgaaaggcacttgaatagcaaagggaacgaaattgaaataaagaaagaagtttaagaaaagatcagagaaaataattgctgtagaagatagtcaaataaatacaaactacatataattatattaatggttcccaaagaagaaaaacaaaacaatgaaataaaactaatatttaaaactataatcaaagaaaattttccagaaataataggcctgactgtaagtattgaagggcacaacctttaataccttggaattacctccaagtaccttcaaaaactgactcaaaactatcaactcctagtcatgtgctactaaaaatattaaacttcaattattatttataatcatctctgggccttttagtgggaggagtcatttgtaaaagaaagaaaatcagattgaaattagacatcttgacaacagacaaagcaaggtaagagtagagcagcattttctttctttctttttttttttcttttttttttttttttgagatggagtttcactcttgtcgcccaggctggagtgcaatggcatgatcttggctcactgcaacctccacctcccaagttcaagtgattctcctgcctcagcctcccgagtaactggaattacaggcatgcatcaccacgcccagctaattttttgtatttttagtggagacggggcttctccatgttggtaaggctggtctcgaactcccgacctcaggtgatccgtccacctcagactcccaaagtgctgggattacaagcatgagccaccgtgcccggccagaattttcaaataactcaagaaagagtatgagccaaggattttattcaaaccagttattctttaattattaaggatctagaaaaatactttaaacatgcaagaactcagagaatactgtactcataagccctactagattaggaaattttgacccaccactttcagttcaagacatgtcaggtggacaaaaacatagtaaatatatagaagaagacctaagaaagcaaaatcagtaagatagatcctttttaatgtattataatagtaattattaataatattttaacttttagtttcaggggtacatgtgcaggtttgttctataagtaaattttgtgtcaagggagtttgatatacagattattttgtcacccaggtaataagcatagtacctgataggtagtttttcgatcctcatcttcctccactctccaccctcaagttggtcccggtgtctctttctcccttctttgtgaacatgtgtactcaatgtttagctcccacttataagggagaatatttagtcaagatagatcccatggctatgtattgaacttaaacaccctgatattagagaatacaccttcttctcaaggtttcataaaacattcacaaaatttgagcaaatattaggtaacaactcagtgagtttcataagttagaaacaatacaaacatcattaccagatcatggtgaaatgaacgtacaaattaataagaatatttaaataccagaaaagcccttctatctgtaatttttttaaattttaaacaattcttgtgtataaggggaaataaaacataaaattttaaaatatctaagaaaaattataacgaacacaccacatgttaaattactattaaaccttgtataagatgaaaattcacatcaataaaagaaaacaaatctgaaaaatcaataaaaagaaaacacaagaaaggaaataagaaagatatagcagaaattaatggagtaggaaacaaaaataatagaaagataaataaaatagtgttaaaaattaacaagtaggcagaccataaataatctgaaatcaagagaaaaggggaaatatatacgaagtaagaaatgaggagaaataaccattgaaacagaggaaagttgtaaaaaactgtaagtggcaacttttcatgaatctttttgataatgattgagccatttcgtacacccaccagcaatgtatgaacgtgtttacgtctccacggacattgccatcaaactgtgctgcaagcttttgaatcgtcagtttgacaggttagaaatgacgtcttagtgtagttttcttttgtttttctcttaagaaaaagtaaggttgactatcttttcatatttttaaggatcttttttgttacctgtgtgctcatatctcttgcctttttttccattttctttttcttttctttgtctcaaattttaagagtttaagaagagtcattattttgaatacataactctaactgtataccctcaggggaatatattctaaggacaaaaacacaaaatttgaactttacttagtaggctcatttctagtaatggttttgctataataattccaatactgttttgtgcatcttataggataagcaaacaggtaaatatattgatgttactgggaacaaggttcattgtgtggaaaaggaaataaaaatatggaatgagaaagaagaactctgaagtgttggattagaattggggatatatatatatatatgagcttgtgcttttaaactgcatatatgcatgtcttagtctgtgttgctataaaggaatgcctgaggctaggtaatttataaagaaaagaggtttatttggctcatggttctgcaggctttacaagaagcatagcacaggatctgcatccggtgagggcctcaaagcccttccactcatcgtggaaggagaaggggagccagtgtgtgcagagatcacaaggcaagagagagaagagggaggtgccaggctctttttaacaaccagcacttgcaagaactagtagaacaagaagataactcacttattactgccaggatagcacgaaaccatttatgaggaatccactcacatgactcaaacactttccattaggccccaccttcaacatttggaatccaatttcaacctgagatttggagggtcaaacatccaaactgtagcaatccacatatatgtgtgtatacacacacacacacacacacacacacacacacacacacacactctaacaaagcaggttataaaatctaaaaatttttttatttgtttgtatattcctagtctgtcctctgaaaggacttaaaagcaataacacctcagtagtaattaatacaccttatacccaaactttgatttctaaatacatttcctaccaaaatctccttgaaggattggctgtttctaggtctgtggcagggaaagtaagtataaggtaagcctgggatatcttgtgctagaaagcaaggaagtgttcaggcatgccaaaatgacacaggagccaacttgaagggattccccttggccaaatttgagtgtcagaaagaagaatggtggtaattgattatacactgaacaacaacaaaaagaatttaatatttgtaatatggaaaaattaatcatttaatttctagaaataggcatgtgttctactttaactcatgtaggtccctttatgcataatcatagtctcatccaaattaggtattacaatagtactgccttatccacagttttgcttcctacaatttcagttacccatggtcaactatggtctgaaaatattacatacaataagatattttgagagagacaccacattcacatagcttttatcatggtatgttgttatacttgttctattttgttattattgttcatctttttaatttataaattaaacattatcctaggcatgtacacgtaggaaaaaaaaaacatagtatatgtagagcttggtactatccgtggtttcatccatccattaggggtcttggaacatattcctcactgataaggagggcttattgtattatttctactttacatataggaaaactgagactcagagagcttaggagcttgtacaacatcacatagctaataaatagaagagccattactcttcgaatctgtctgacacaaaaagagcctgtgccctcacttattacactaaacagcctctaaaatggagctcatattatatactgctttattgcacttgctttgtaaacatttttctctatcatgaaatattttctgtaatattcttaatggcaacacgatcttctattgtatatagtcatttgtctaactgatcccatttgttggacatttgagtaattttcaaaatcttgctattatatacaatacgctgaataccaatgttttaaatctattcagacctttttcttaccataaatttctaaacattaaatggcttgataaaaatattttttaaaaaatccaacactttggatatatattgccaatttgtccaaacatttttgcaacactttacactaccagcagtatgtgagggtgttcgttcctctgaactctggaaaacttttgacatcatcatttataaaaaagaaaagaagccattttgataggcaaaagggtatttcagtgtcttagtttgcattttccttccatatttattgaggtatattgaggtgtaaatgacaaaaattgtgtatatttaaggtacgcaatgtgatgttttcatacagtatacactatgaaacgattactataatcaaattaattcatatgtctaacaccctcatagttgccttttattgttcggtgatgagagcatttaagatccactctcttagaaatgttcaagtaggatccttgcttccaaaatgccaaaggaaagaaggaacaatggtcatgccattcacttgcagcctgttcactgcaagaactgtgctcaatgcatgcccaggaataaggctattaagaagtttgtcattaaaaacatagcagaggccacagcagtgagggacatttctgaagtgagccctcaatgctcacagtgtttcccaagctgtatgtgaagctatattgctgtgcgaattgtaccattcacagcaaggtagtcaggaattgatctcgtgaagcctgcaaggactaaacacccctaccactatttagacctgtgggttcttccccatggccccaaccaaggcccctgtaaggagctgagtccttacagactgaaggaaaactactctctggagaaaaataaagtggaaattgtacttatttttaaaaaaaaataaaagaaaaataaaataaaagaaaactcctgtaatcccagctacttgggaggctaagacagaagaatcgcttgaacctgggaggtggaggttgcagtgagcctacatcccaggcatgtcagcctggacaaaagaaagaaaagaaaagaaaaaaaagggaagggaaaggaagggaaaggaagggaagggagaaaagagaagagaagggagaggagaggagaggagaggaatcttgaagtatacattattattaactatagccagcatgctatgagaagagaagagaggagaggagaggagaggagtggagaggaatcttgaagtatacattattattaactatagccagcatgctatgagaagagaagagaggagaggagaggagtggagaggaatcttgaagtatacattattattaactatagccagcatgctatacattagatttcgagaatttactaatcctgtgtaactgaaactttggaccctttgagcatcagctccctactttctctacccccagtccttgacagccaccacgctgctctctgcttctatgagtctgacatttttagattccacatgtgtgctagatcatgtagtatttgtctttctgtgtcttgctttgtctcttttaagaagtgtttgttcatgtcctttgcccactttttggtggggttgtttttttctttaaatttgtttaagttccttgtaaattctggatattagacctttgtcagatgggtagattgcaaaaattttctcccattctgtaagttgcctgttcactctgatgatagtttcttgtgctgtgcagaagatctatagtttaattagatcccatttgtcaattttagcttttgttgcaattgcttttggcgatttcatcataaaatctttgtccatgcctatgtcctgaatggtattgcctaaattttcttttagggtttttatggtttggggttttacttttaagtcttcaatccatcttgagttaaagttttaaagcataaggaaggggtccagtttcagttttccacatatggctagccagttttcccagcactattcattaaatagggaatcctttccccattgcttgtttttgtgagatttgtcgaagatcagatggttgtagatatgtggtcttatttctgaggtctccattctgttccattggtctatatgtctgttttgataccatgctggtttcttgtagtatagtttgaagtcaggtagcatgatgcctccagcgttgttctttttgcttaggattgtcgtggctatatgggctcttttttggtttcatatggaatgcttgtgatttttgcacattgattttgtatcctgagactttgctgaagttgcttatcagcttaaggagttttggggctgagacgatgaggttttctaaatataggatcatgtccacaaacagagactatttgacttcctctcttcctatttaaatatcctttatttctttctcttgcctgcttgccctgccagaacttccaatactgtgttgaataggagtggtgagagagggcatccttgtcttgtgtcggttttcaaagggaatgcttccagcttttgcccatttagtatgttattggctgtggatttgtcataaatagcttttactattttgaggtatattccatcaatacctagtttattgagagtttttaacatgaagggatgttgaattttattgaaggccttttctgcatctattgagataatcacatggtttttgtcattggttctgtttatgtgatggattacatttattgatttgcatatattgaaccagccttgcatcacagggatgaaactgacttgatcgtgatggataagctttttgatgtgctgctggatttggtttgccaatattttattgaggatttttgcatcaatgttcatcagggataagcaatatattgttttaaaatatgtatatattgtcgaatggctgaatcaagctctgaattttatgcttttgtatgttctaatatttattttagttgttagttagcatcctttattttcaggttgaaaaacaccctttagcatttcttgaatagcagatctaatggtgatgaattcccttagcttttgtttgtctggaaaggcctttatttctcctgaatttctgaagaacagctttgccagttataatattctcagttggtagggttttcttttttaatactttggctatatcacccctctctctcctagcctgcagagtttctgccgagaaatccacttatattcctttgaaggttctctgtatatgataggccacttttctcttgctgttttcaaaattctcttttgttgttaacttgtgtgaatttcattataatatctcagtatatatctctttatgttcaatctatttctattttggattctttgggcttcttgcatctggattttcatttccttcttcagatttgggaagttttcagtcattatttctttaaataatctttccacacatttctcattattttctctttcgggacttccataatgtgtatacaggtttgcttgaggccaggcacggtggctcacgcctgtaatcccagtactttgggaggccaaggcgggcagatcacctaaggttgggagttcgagactagcctgaccaacatggagaaactctgtctctactaaaaatacaaaattagccgggcatggtggcacatccctgtaatcctagctactcaggaggctgaggcaggagaattgcttgaacccaggaggcagaggttgtggtgggccaagatcatgccattgtactccagcctgggcaacaagagcaaaactccatctcaaaaaaaaaaaaaaacagatttgcttgaagagaccataagctttcttcactctttttcatttgtccttcctttcgttcctcctactgagtaatttcagatgacctgcctttgagctcgttgattctttcttttgcttcactgactattgttgaagctgttgatggaatttttcagttcagtcattgtgtttttcagctctggatttttttttatggcttctatttctttgctgagcttctcatatttcttacgtgctgttttctgattttattcacttgtctatctgtgttctcttgtagctcactgaacttgtagttcactgagcttctttaagttaattattttgaattatttttcaggcattttatagctatccatttttttagggttggttacaggtgctttgttgttgttgttgttgttgttgttgttgttgtttgttttttgctttccctttggtgatgtcatgtttccctgattattcatgattcctgtggcattggcaccttctccagtcattaaagactggcttcaccaggagaagctcttcacctgtcagcttgtccagggattctgtgtggaccagcagggaaggtctctgggttggctttgctgaaatccttgggctggtaagcctggtgcatgggtcagtaatggcaccccggttcctgggtcagtaatgatggttgagcctggagcttgggttcaccagtgccagactggtacctggggccatggaagatggcctggccctagggtaggcctaaacccttgggccatgaagaatgaatgcagcttagggctataagggccatccttgtgctatgatgagtttggatcttgggttggcagtggctttactaaaggtcagatccgtgggaaccagcctgatactggggtgggagcctgagtccattggagctagcctaaagcctggagccacagggaccagccatgtttagtggttggcctggagcttgggtctatgtggaccagcctggagtctcaggccttgaggccttgcctatcactagggtaggcctgtaagcttggtcattgggtgccagcctggcaccagggttccctggggtgggcatggtgctgggttctacagtgaagttaggtgtttacttcactctcttctgccacatggaaggtatttctctccacactgtgctgtgtaagcctgggagagtagtattgcaggtaatgctaaactattcttcttacactcttcaatgcatctttttttatgtctgtgttccaccagatactgtaatctctcacctgaattccttagcacttgtgaaggaattttttagcctgaatgattgttcaagttgatgtttccatgagggagcaagcactggaaatgcctattctgccatactgttgacatcactcctctaatttgcgttttaaaattaccactatggttgaatattttaaattgtctctgttaatttccatttcttttttgtgaattgcctattgatgtcttttgtccatgtttctattgaaaggtgcagctgatatttattgatttataagaaattttatatattgaagattttaacataaactgcatattttaacattgtttaaaatccaaaattacagtttcaaaccatacaaaaataatgaaactaaaatactgccatattattttcccacatctattgatatcatggtaaagcatttcaggaaacattaagaaaaaattttgactccttttcaggggtgatatgaaattgagttaacttcccactgcctaccttttctttaaagagaaacttgcatctttttcaaaaatagtgagcaaagcttaggacaacaaagtgatccattttgacaaaaatgctaagaagattgaagtagacaagagaaaagattgtagaaccagtagaaaatatatacagtgtattttacttcagctacatgtgacccagtaattcaataaaatttaagtgtcattataaaaagattttgcagatgtacatgtattttgaattggagggtttttacagagttcccatttctctcttatgtacttacctgagattgatggaaaaaatagcttgaataatcaggctatgacaaatagtggaatttttccctatgcaaaagtaacgggttggaataaaaacttaacctataacattggcctcattagtccgatattccagtcaaattacttcagtactaaatgtcattgaaaagaagaaatggattacgtattctcttggccttaagtaagactgaatcagtgtggttgggtgaaacaagactgaggtagaaaaatagggtcctagtgtcagctctctgtgtcctaggtgcaaagcatttcctttctctaggtgttattttcctcttctgtaaaatgaggagattgaggcaaatggcttgtgtgtggtgtgttctttccaaaatatccttttaattgcagaacacttttagacttacagaaaagttgcaaagatagtacagagaattaccatatactcctcatttagtttctcatatatttttttagatagtacaaaggctgtcatagtttcttctattgtcaacgtcctatatcaccatggtacatttgtcacaactaggaaatgaacatcaataattactcttaactgcatttgacacttcatttggatgtcaccagttattcttttccaggatccaattcaaaataggatattatatcgtgtcatgttttcctatcttcccatggtctataacagttttctgacctagatgacattgacaattttgagtagcactggccaggttgtttttttaatgtccttcaatttgggttttgctgatgttgtgcttatgtttaaactggcagtatgcttttggagaggaagaccacagaggtgccattatcattgcatcatatcaggtgtctgtgccataatgtacatgctatcattgatgataacccagctgaggtagtgttttccaggcttcttcactttaaatgtactggccccctcctttctaaaccatactggattactctgtggtctttttgagctctaacatagcatgattttattgttgcagacagattcccttacttgtgcagatcaatttgatagagtagaatccatcacccaggattgcatacttgtgctgggtaactcagctgaaagttttcttgggacccatttcatactatatagctacgtgagaattatcagttattattcataaaatgagactctaactgctttatgctaacctttataaaaagtgtactctactaagaaatgatgataccttttaaaatcttagggatgctctaatttctggaatccttttaccaagaaaacccaaaacctacaacttccagatccccagtgccctgatgatagaggaaaggaaattaaagaaatttgcagctttgggggatgttgatggggatgggaacataaatgaatgtctgttgtatattaagtcaaggatttggaatcaggaaattaggtgaggtttttgttttaactctacagctgtgtgaagatggcagctgaagttctctcaaagaccggaggccctctgtgttactctcttcagagaatcacaactacacaatcatctcctagggcaggaaagtagagaattcaatgagtcaatgactttctacctttctccacttccaggatggttttgtaaagggatcaattaaacaggcttaataatgattgctaacctttattgggcatttagtatgtgccaggcatttttttctaggtactttacatatactgactcatttagtgttcacaacaaccttatgcagatgttgttattgtgcacattttatggtgaagatactgagaggcagagaataacttacccaagattattacacacactagttagcagcagagttgagatttgaaccaagaaaccttggctccagagtccctgctctttattataccatatgacaactgcctccctttacacagagtgaaatccccaacagggccagttctttttgcaaccaaacagtaagtgttgtatcctcagcaactaggacaatgtctaatacataggatccagccaacaaataattactgcattaaaggagaagacttgaggatccggatcatgaatcaaccccatttgaataatacattagtgactctttcagaagaacactgtcatggtgtcacttcagaaaacccagaacaaactgggtccttataatcaccacttcactctctctacctcctcatctgttcacatcttataaggcagatgagaaggtttcatagtttttcatcactcatcgttttccatcttctctatcatatcctgtcttcccagccttttataagccctgctccttaacgttaactgtgaataataagttaatgacagggtttttaaaattccaatatctaaaagtttgcagaaggacacataccacatatttatggctatgattacatgatgctaactcagaaaagtgagtttcaaagtatcagctaccagaggttgtggatataaatcaatgaatacatttctattttaaaaatttaaataatatacaggtcaaatgggtaagaggaagagatagctgtgtatgtctatttcttactctctatagtcacaagttttatttgggtctttttaaaagaacctggttactattgccaataagtactcaaaccaggaaagagagtaggagaatatttaggaatctgagaaactcccatcatcaataatgaagaagtgattggcagtgatttggaccatagagaaagggagaattagttgagcagaaaatgaagtaaaatagaaaaaaaataaaattttaaagaagaattaaaagtactgattcatgtctaaatttatatttttgctacgttattcattaaactgttttttaaatttatcccatcattatgctgcttattcttcctgactccacaaagcaaataataatacaaaaataaataagatttgagttatggagagcacttaatggtgctgtgacttgagatgaaaccactaaataattgtgtctgtctgataaggaatacacagatgggcccgttatgcaactgcaaatggagatcatatattaaacttgtgataaggtacctaactagacatgttatttataaatattgctgtagtcttggaatggaaaatataaaatacgtagtaaatgaaagttttaagataatataatacagaactgggatattaaaatgatttattactctgataggatcttttccatcctgagtattggataaaactagcaccatactaaggcaaaagaaaaaagcatgctgcaatagagaataattcatttcatttaggagaggaaaagtagggattcaaacacgtggagcaacaaaaaaggtgtcctcattgctctgttatactatctcaatcttttcttaattggcatttaattttaatgtttcatcatggcagacttgcaaaatgtgttttgtaaaacagttcaagttaaaatgccttttgttttttttcttttaattagcgaagttctttctttcaaagggaattctacctatatacgacacaacagcttttcgggttttcaaaaatgtttgaaagagacctcaaaaccatactgactacatttaaattgctttaaaaagaaacatttaagtatgttttatttatgttcatgatgtagtgcaagcacaaataatatttttagtataaaatgtatatgtatagccctaggaaaaaaagagaaaagttgaatgaaactgctgaggcaatagtagataccataaataaacatgcattacttctttaatttagttcttgaaaaatgcttctctgaaactaatagttttcaatcctgcatgtaatatggttattatcaggataaaattcagatctgaaggtaatttatcaaagggctatagttcactcatatgccaatttgatgtttaatgtaataaaaatgggatttattttaagatgggaagataacctggtttctgtaatgttggcagtcactgcatttaattcaagtagcatttatttttgcagtgatattccttattgcagaagcatctagtctcacatcatggccactgaagtatcggtctggtgaaattgcttcccacgggagttagttgaaagcctgaagtcatcaggggtcaccatctgggtaatgtacttcgtatatatttcaggaagggaactgtccaacatacaagcagatctgtagttttgacaagccttggaagtaaagtacaacagctgtagcattccctagcctgaaggaacatgaagggaactagtagggggagaatgctgacaaaaagggaaaacaaagtatcttagaaaatattatatgcttttgtcttggcatgctgcgaagcaggacatgatccataatggtcaggactttatttgtaagataggtttcaaactttctaaataggtttatttagtggatttagaaaataaaaacccaaaattcttgcaacaaataaatataacacccctagctgaatatctttgcatttcaaggtgcaagatgaattccttgaaagcaaagttacatttgtcttaaaagtcttataatttcaaggttaacttgtatatttattatcaaagccctatttattgttaggtgtattcaaaaattacctgtaagagagtggacacaaaaccccaaaagatacataataacatgaaaaggggtcctgtctcctgacagtagcactataaagatatttcaataaatttaaatacctaaaaggaattcttcccaacacccaaattttccttattcagatattttgaagataattttgtaggccactagatttcaaactatattatttggatcttttggacagccaatccctttcagtcaaattctgttttatctgttttatgtatctgggaactgttcatatttaattgctgaatggttctgctgctttgaaatgttttgaaaagcccaattttagacagaaaatagcaataaaagagatagaataaaacaatgaaactattcattcagcttaacaaaggtttgttgagcacctggtattttaaaattatataataatacatgaatacattatcattgtaaaagattctaacaatactatgaaaatgtcaaagtatccttttggttttcacagctccctactctaaacatcaatagtttggtattcatttttcaggtctctttctatgcatttaaaaaatgtaaatatatataaatacatattttctactaaaaccagatcgtagaatatgcattgttctacaatatttttcataaaatcttagagcttgtttcatttcagtacatacagatcatccagtgatgtgttgataaatgtttaacaagctctctggcccaaaaagcctgatctgccacatttcctaattcccaggatgtaaatacacctgccatggtcaatttcaactgccaatataaagtcattggaggtggaattgggaagagatgtgcacagttggcttttgtaaaccagtataagccagctccagcatatcacttgatcagtcctttttctctctctttttggctttttattttgaaataattttagacttacagaaaagttacaaatatagcacagaatcactgtattcctgtcactgagcttctcccaatattagcatcttgcacatagtacaattactaaaactaagacattaacattggtatgaggctattaactaaacttagagtttaattcagagttctccagtttttccacagtcttttctgttacaggattctttctagatccccatattgtatttagtcatcatgtctccttagtttccttcaatctgataatttctcagtatcagtccttttaattcttataaaggatttcatagtaagcgtgtaccactcttccatagatgggtatattggttgttctaatttttaactacattaataaagtcaatatattaacaatgcaatggcgaatttccttgcacatgcccctttatgccccacatgtgattatttctttagtacagactcctagaagtagaattccttggtcaaggaatattctcaatttaaatagtgatagatatcaacattgtcttccaaagccactttaccactgtacactcctatcagcaatgaagagtacttcctgactaccaatcacagagttaggtaccagaaacagaaaaatgcagaaggcattgttcctgcctttggagtgcttaataatgatgagacagacatgtaaacagatatctttaatatagtatggtagattctatgatagggtgctaaaagagaaacatcatatctctttgtgaaatgtaggtagtccaagatcatcactgctcaacagaaataattgtgaaccatgtatgtaatttaaagttttagagtagccatattaaaaaagtaagaaacaggtgaaattaatttaaataaatattttatttaacctgatatatccaaaatattatcatttcaatgtgtaaataatataaaaatattaatgtgatcttttatattttttcttttatatcaagtcttcaactctgactagccacacttcaagtgtgcaacagacacatgtgatgagtggctaccatattggatagcataggcctaagttattcagcatgtatttcccacatttacttctgacgcattcctgtgggatttttttttttttttttttgagtcaatgagtgcctcttgaaagagagtgggatgggaaaggattattgattataaatgttgctagagaccaccagtcttatttatgagaaacatagtccaacattctaacagtacgcagaaagaaaactgcagagagacttggaggttgctacagaaatgtgtacgttaagaagaggaagagcttctgtacatggggtcagcctaccttgagttccaaggtgcttgattgaatttggaattgaggagagccaagacaatccattcattacctgaactttgtaatgaatttataattttagagcacagctctttgcaattggatagaaaaggaaggagaataattgtaaaatgtacagggctcagcatcagggaacatttgctaaaagagcattagggactgccatttttaatctgctgaaaatacaccattcctggaatatttgagtagacataaacattctgtccaaccattgaatttcagtgaaatgcaaataacaggatgggtactccctcagagatctgggtagcatccatctccattcattgagtatatatatatatatatatatatatatatatatatatatatatatatatatatatattttatatatgtcttagggaacagtaactttgaccttgcttacagtcaagagtgcttatattacatctacttcaaccagcagtgctcatttggaggtatatattctggtatgtgagattttaggtttattactttctaattcttatttgttggtgaccagcttgcaaagttggctagcgtactgaggtaacaagattatgggtccaggacttatgtgtatgagtgttcctaccactctttgcctttctgactgagctcacactgggctccttagtatttctcacacacttcatgtaagacttcagggctttctataaattctgttttgtctgcctggaagattcttccactagatattcacaatggcttcacttcattctaatcttggttcaaatgttacctcctccaagaggccttctctgaccacccttacctatttttaccttcatagcacttataactacccaacgttatcttgtttatttgttgttttttgttttttggtttgttcccttaacgttgtattctatcttatattttatatcgtgtattttttatttgcctgtcttaacccactaccctctcatgtaagttctgggagggtagaggtttttttatgtttttgctgctgtaaactcagaaaaaaaaaaaaaaacagtgcctggtttaaagtaagcactcaaaaaagtatttgttgaatcaacatgtgaatatgacttaatattgccctgtttgttcattactaattttacccttattctagccaattggctcataatgtctattcttgggtttgggggactcacctaaacagtgtggctctaaacacatagcataaatctggatgggaatccactagaaactaaggaagctgtctttatactgcatctaaagctgacattcagccagtgtgtacacactggttagactgtattagttgtttatatctgatagccattttggttggccagtacctatgtttggaagaaataaaaggccagtagccttgccatgatacctgtctgtggtctgtagcaaataattaactttcattatatattcacacaaacatatattacaaacagcttgttccctgggaaagatatagtaagttcaaaaaattacaaagcttcactgctctcaaagagtgttctactaaatgtgcccatacctctttatctgtcttgattggctggaagcagtccatttcattcgatggtgaaaaattaatccttaccttatatattttgaagtgaatctcaccacatgcattttctcgcattttcaagtgccgccaggaaagtggctcaacttaaagtatataaaatagcccccttagtcttctaaatgagatctactattccttttgttatatatggtccatctaatttcacagaagtaattgaacccagggaatgaaacacattttcaatatagctcctactatccatcatattcaaattatttgggaggcagagtagaccaaattttctgtaaaacggaaaaatacctctaattggaacaggtgtgttaaactagagtccattggcaaggaaatctcaaggatgtcactaatatagctttattaatgtgccataccataccttactcagaaccactatcctttgagttaaaattatttccaataattgcaagagaaattcatcaggcagcactggccttaatccaaagaaaagggtagaaaccagttaaatgcttaaaagttttaaggataaattaggaagtaggtgttagaaatctctttagctccaactaaaagtggatgaatgatttttaaataggctatccttctctgttctcggtcactaactcaaatactatacatgagtgttacacatactaattagcccctttcagttcacctaggaacacaaagagaaatacgaaatggcttatgagcagattcacttttttttttttttttttttttttttgccttttgataggatttggttgatgttgaaaaatgcaatgagaaaacaaacaagaggtttctccagctttttgccctaggaactgttttctcctaacattctctcccttcagtgacttcattcactctcacaacttcaactattgcctctgtgcatatatgacttttcattctttttctagctctaatatcctccagaacttcaaacctcctatagttagcattcactatctggagggcccatcagtcccagacacccaacaaccccaaaggctgaattcattgcattccttgcatcttctcatcctgtctcaagccacatattcaaatagtcatcaatcaacaaaacacaaatccagtaccaactatttgtagcaagtgctagactaataaagaattctctaactctattaatggttccaccattgtttcagttagactcaaaaccttaaccattttggattcctccctcctttctctcacttttttctacgccctcccacagcacacctatacacatgcatgaatgtgtatacaaacacacacagagacagagaaagcgagagagagggagagagagagagaaagaaacttcttgccaaatcctgaaatgccatttatgcaatttctccttaagaaatctccttctttgcattcccactgcaaataactgagacactcctgtgacactactctaattggggcactaattacttctttcctaaattattgcaatgccatcccaattgatttatttgccaaacctttaggtctccaattcattcttctccatactactactggatttatctttctgcaaaggatgtttttattatatcagttatttggctaaaaaccttcagtgctccccactctcaaattaatcatccgaaaaattctgatcatatcactcaacctgtcaaaaaatagaaatgcctctgcgttgcctaataagttgaatccaaatgtataagtgtggcaccagtgtgctccacaatatggctctaatcttcctttctggcgttaacttccactggcaccagcacatagctaagctccagtgaaccccagcaacttcttttgcctcagatacatcatgtactttacaaagtcatattttgttcagccctgtcccttctccccaccaatcgttgtcacctgtcaaagccctacacatccttcaaggtctatatctactcccacttccttcaaaaattattcttgatcagcccaacctattttaacctcctgttcctttaaaccgaaagctttctttttcacagatggcaaatgttacacatgttcattgtaaaaaaaatatggaaaacacagaaatcataaaaaaaataaaaattctctgtaagcttcccatgctgttaacatgttgctatatattcttccaaacctttttttctccagacatgaacatgtgcacacatacacaaacacacacacttcagatcacactatttataatgtttagtagcctaatgtttttcatttgataccttatgaatatttcccatgccattgcatggtcttctgcaacatgatttttagcagccgcataatcttgtattatttactatctcatcagttatttgattaatcccctcttgatgaatatttagattgatcataactttctaatattgttttcagatgttacaatagacagcattgtactttggcaacattcatagttaattcacagaaattaaattgttagctcaaagggtaaatcagattttaagttcatttaataaatggtgccacattgccctccaaaaaaggtcactgtatttttatactctcatcaggagtgtatgagagtgcccatcttcctgcacagtgaccaacactgggtactttttaatcttctgatagcagtttaaacctgtcttatgtcaatcattctgcataatattattttatcctggtattactaccaaatcccaccctaataagcatctacattttaacaccggcagcaactatcatagggctttattcatactaggcgttcaggaaatatttgctgaactgaattgaattaaagccatagagaaggtcttccatgttctcatggtagtctgtccaccattactctgtaatagtttccatatggaaactagtgttacatgactaaggggaatggaaaaggaaagggtcacagcagtgagaagttaagtctaattgtactatagttgattccaatttctaatcctatcattgggatagctttagcctcaaaatgttaacaacagctactttaacagctgttaacacttatatgtgtgtcgtagcatgtaagtagctacatgtatgatgtataggtataaactcccagttacttggcctaactaaaagaaaactgttcgtaacatttttaggtgcaaagggatacctggcttggagatgttctcagtgagtctggaataaattaatgtatggcttgttctcttgcagcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaaggtacagtgatcaaaatgattgattgttgattacttttcttctaatttggtcattagaactgtagctgggatggtttcacttcacattaaatttcatgatcacttgaaagaagtcctctacgtggacagaataaatgcatgtaaatatcttgtgaaagcaaattttccttgtttccagtgccttgagtataaaccaattaaagttttcaaatatgttggcaattttgaaaatagataaatatttacagaatggaggcttcaatacaatggaaattgcatttcgcatataactaccctgaagcaacgtgggattttgattacattctctgtgtccaagcccagcatttatatataacattttacaaagggtatatggaaatttcttctgtttgtaatacgaaaaagctttttctgcttaatgtaaaggtgaatgtttatgtcaaagttggataacatgatttttttctagtttgggaacatgaattcttcctagttgggagaaagaaaaaaaaaatcactttgagtcctgaactgttaagtttaaccaacatgagcttgaactacctgacttatttataataaatgtcacagtaccagcactcccaacatcttattcacactgaatgatcttagtcttaatatacaagcagtgaaaatagctggaaatttatatttttattgaaataggattcagtacagagggacttgagccttgtaaaattccaggaagtcaatttaaacggtagaaattgagaataatatatatagccagcaatatcctgagtaatttttggagaccaaacgtaaataaatgaatgaatgaccaaaaccttacctccaagaagcttacaattttatacaggtggtaacacagtcttattttggttcattagttgcaactaagacatcattttttaatacagtagttatttgggttactactcttcccttgtgtttttaattcctttcgtggtggcgggggggttgtttgtgggttttgtttcctcttgtttttgtgtgcttttgaaaaggtaactgtaatccatgcttcagtaaaaattaatgcttagggttcaggaaaatattatggtttgctctagttttcaattcatgatgcagtttgctgtatgttctcatttcaaaatacttgtttctagcctggagtgacctttcccagcagtttcactgttactcctgagagtggctgaggagagtagaggggtcagaggtggcagataagaaagtctgccacactcactgctcagatttttcttccttatctcccttacctgctttttctcccttaccttctcttctgctgttttatccccttatatctgaaagtacaagagctatcatttggtattatctgcctagggtttcttgccattcacactaaaaatcagaatttatctgtctgaggaaaatgaaacatgcaagacagcaggtcatcacatagttgtcattatagtatatttgattttatattctaattcagacctcttttgattcctttccataaagtaagttgatgatgatggctaaaattaaattaaaattaccacgtgtcaagaattgttccagaaactttacatggattatatcatgaaggtcacattatggtccccattgtccaaatgagaaacagaggcacagagaggttaagtaacttgcccagtgtcacagagctagtaagtggtggtctgattccagagtccagtctcttaacttctacactgtactaaaatcctcatatggaatatctgtgaagaccacaaaaaactttttacacaatgaaagcaaagtcccagagtctattcgtgatagattttagagaaattctactcacctctatttttaatgtgttgtgacaagtctcataaatgaaaaatgatttaagtttctgctcaattataacaacaaacagagcaaaccgacttcaattaaatactttattaagaaaaatcattatgggttgatgcctcatataccaagttgctagcttatcctgactttttctggaagcctgaacaaaaccttaactataactgcacatcatggttttgctgtattaggtctttactgcatattacttaccaagtaaaaacatagctccttttttttttaatgccatatgtatactaatccaaaccttgcagaagatataatacagtagaaggatattttcaaatgttcagttgtatccttttatgattttctacataagacacatcccataaatacagctctagaagcttgtcctgatactgtatgcactaaaatatgaaactgacaaccagaccattcttcctaaattgttttctctactctcctagaagattgggcattatagcactgtggttaaaagcctggattctggagtcagagagacctggctttaaatactaactgtaccatcattatctctccaacctcaagtaattgacacaacctcgcccagccagtgccctcatctgtaaaataagggtgataataatagtacctgtctcatatggtcatagtaaggagttaattaaacaattgatataaagcatatagcacagtgtctgacacattgcttaatttagcagcagttattatcggaccaaaagattggaaaatcaccttgaggtttttgaacttcattgacattccgttaggtgctatagaacctgctttcaaaccactatgaactttgcagtgaatgatgaccttcttgagatcgaagtgttttctctctttaaagtttggtctctactcaccaatctaaaacctattatttttaaactgttaccactatcatcatcagataatgatgaatggcactttcttttattatactttaagttctagggtacatgtgcacaacgtgcgggtttgttacatatgtatacatgtgccatgttgttgtgctgcacccattaactcgtcatttaacattaggtatatctcctaatgctatccctccccactccccccaccccacaacagtccccagagtgtgatgttccccttcctgtgtccatgtgttctcattgttcaattcccacctatgagtgagaacatgcggtgttcggttttttgtccttgtgttagtttgctgagaatgacggtttcccgcttcatccatgtccctacaaaggacatgaacttatccttttttatggctgcatagtatttcatggtgtatatgtgccacattttcttaatccagtctatcattgatggacatttgggttggttccaagtcttcgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgtttctatttctctacatcctctccagcacctgttgtttcctgactttttaatgatcgccattctaaagggctaatatccagaatctacaaagaactgaaacaaatttacaagaaaaaaacaaacaaccccatcaaaaagtaggtgaaggatatgaacagacacttctcaaaagaagacatttatgcagccaacagacacatgaaaaaatgctcatcatcactggccatcagagaaatgcaaatcaaaaccacagtgagataccatctcacaccagttagaatggcgatgaatggcactttttaaagaaacatcaaattctactggaattggtttcccattaacagttgttatatatatatattatatatctgcttctcatgagaaaacagaattttctcaccacttagttatccaaatgaaagaaaaagagtatttgattatagacatttagtatgctaaaaaatttacgaacactctagaatttcaataagcagatataagtcacaaccacatactgtaatctaccagaaaaatctcagttgtcagtattaaatatttataaaattgaaagtattgtaccaaaatagtccctcactacattagagtcttacaaactagtcataatttttttttttttttttgagatggagtctcactctgtcgcccaggttggagtacagtggtgcaatctcggctcactgcaacctccgcctcccaggttcaagtgattctcctgcctcagcctcctgagtagctgggactacaggtgcccaccaccacatccagctaatttttgtatttttagtagagatggggtttcaccatgttggccaggctagtctcaaactcctgacctcaagtgatccacctgcctcggcctcccaaagtgctgggattacagacgtgagccactgtgcctggcctataactatttaaccagtaaacattatgtaacaactgctttaaacagagcagaggatatgaacaaataaaagacttattcctagacctgagttatataatgtctataaataaaattaaaaataactacccccacgtaatttatcaataaattagaatgttaaaatcttaaagattatcaaatccaatatccttatttagaaattaagaaaattaggtccagaaaagttgagatcacatagaaagagctgggactaggagagaaggtaccgagtttcacgttttatatttttcacctgttattgtaatagtataggataaactaagtatataaatttctgaaaaggttttcaataagtatcacagagaaaaactgaacaagtaaaacaattgattttattcaggctattgcaatagggaggtttgtcttggtcttattaggaaggggtagatgggttacatgtgagatgatttactggtgggatcgtgttgcaatcaggggaagtatcagttagctgaacaggaaatgtgtatctttgtttctagctagtttcagggaaacagacagttctaatctcaactaattattcatgagacaaagaataggaaattggagggtctgtatacggcctttcagtgggttcaggcaataggggaaaagtctgtgtttggtcttttcaggggtggaattataggtgagtcttagggaaatcatgggaaagaagggacagagagttttatcttaagtcatttagggaagggtgttttgtatgtgtttgtttggacttttgtttgtttgttgtcattgttacggtttttttgcataagccatttcccaggacacaaaaaagtgggagaatttcggaaaacaaaaggttggggaatttcttaagcaaaattgttttccaggagcattaaggctcaggtaaagtcttgtattgtcagtagcaatataaatggagatgaaatttattgggtagttgaggatactgaattcctgcaggttggatgccaaaatagaacactgggaacaaagaaggatgggtggggaaagacagaactaaagaatactaaaagcagcctttatctccattacaattttgcataagcctggccttgggggaaagtggcatttcttttaaattcatcctgcacaatctatctccacaaagttgaaaaaaaatgacgtttttctagtcagtgtctgctgaatatatgaccatgtaaacaaaatacagctgattgatatgacacaatttatagcctgtcatgaagatgctttagccaagaccaaatagtgactactgcctcacctctctaggctccagtttctcatctgaaaaataagggagttggctttcaaccgtttctaggggcagagaagaggcggggctagcaggcagtgaaaacgtttttacaaattaaatcttacccagaaattacaaatttaaatagaaaacagataaaagccaagtttctccagatatggcgagggaagggggcagattcctggcaaaactcccgttcccttcctctttgctttatttgccctctattctctcagcagctgctaaggctttgacaaaacacaaggctaacttatctgtaagatccctttcagctgtacacactatgcgttagtgttcaaattctgcagttaaggaagaataatgagccaatacaagtaaaagtggacctatttttgcaaaagggatatactcctggaaagaggttgaaatgtatatctataaagtttgtaaaaccacatttgccatttaaaatacttgcagagaattccgttgcaattcaaacaattaattcccagtttcctaccttataagtttggagttttgacatgtatataacacagcttgcacttagcatttacaattgtaaaatactttaatgtcttttatccacataatagttttattctgtggcagctatcgttaccttttcttttttttttgagacggagttttgctcttgttgcccaggctggagtgcaatggcgcaatctcggctcaccgcaacttccgcctcccgggttcaagcgattctcctgcctcagcctcccgagtagctaggattagaggcatgtgccatcatgccaggctaattttgtaatttttttaatggagacagggtttcttcatgttggtcaggctggtctcgaactcccaacctccggtgatctgcccgcctcggcctcccaaagtgctgggattacaagcgtgagccaccacgcccagccgtgttacccatgttttatagttgaaaaggaaaacacaagaaagttacatgacttgccttgcgcaatagacaatagacataactaaaggcagagctgagattgtgatccagtttctccttactgttagcacccttccttgggctttttctttcatttttcaaaaaaattcctttctcaaagccagtttgtttaaataacggctatcttgattaaaaatctcaatgcatacagttcaaatactgtactcttccttaagagtacttggcaaatcttatatttcacatctaagatctcctttcagcgagcattctccctcctccacaaagcaaaagatacacacacacacacacacacacacacacacacacacacacaccccacaagtactcttgggaattgaaaactaaatgacagtgcaaaatgtactgtttacagccacctttcattgtggacctatccagaagaggggtgtgtttgtgtgtgtatgtgtgtgttttgcttttttttttttttttttttttttcttttgctttatctgagacataaatgccttggaacattttatacaatgccaattgtggacctgaaataacaggttaaattttaatttacttaaggtttggcagatatttatttcacagacccaatcagtagataaagattcattatgtggtaccaaactaaaaaactgcaccaaccccacccaggtaatcattgtgcattcagatggaacgcagtcctgcagtataattctgtggttctgcaatattggttcataggacatgtggatattcagcagccctttgagtcaacccatagtttcagtatcttttatttaaaggatattatagcccaagatattgaggtagaattgggaataattcatgtaagcacaacaaaccacatgaataaaatagaagtaatgcgctaacaaagacaacattgttgggagtgtaacagtattatttttaaagattgatggcgaattacagtaaatgtttcctataatgctatatagatgtttccctaacagaaggtttcagagggcccagctagagtgctgcagcttgttttcaactatattaaatcactttatcaatatacttcagttttaacaaaagctttcctaaagcatactggagacttgacttctaaaacagatttatggaaagggttccctatgctgaaagacaaacttatttattgtattaaaaattcacgttaaatgtccttggtcatatatgtttagtgtttcattcttgtttcattttcatcctcattttacttaaaaaaaaaaaaaaaaactaatacacacctttcctgtgatgcagtaagaaataggtctgtcttgtggtccctctagtctaacagtctgcatctgacagggtcactaagtggtatgctatagaatgccatgtttatcctcctggactagtcctttcaaagctaagggatcttcccataacatttttacaacattttagttttgtggaggagctagtccattgtagaggtttatcagccatgtgtatatttaattctgttgagtatccatttatatctttgaacctgtattacttttcaaggaagtttaaacatttactagccttttttgtggagtccaatgtaattctagttacttgaagtttacttttgactatgaagttttacagttccagaatttaatgcacaaatctgcatttttcctgcgtgtaacttttgtaatctcctagatgataatcacacattcttttttagcctacacatgtctaatattaagagtccttgcgtttacttctgtattcttcttgtagcttccattttcccttagtcattttaatggtcattttctattttcattataattatactgaaagtgtcagccacagctatacacagataccatcttctcttcttggttctaggagagggaagaataacagttaaaaagttgagttgaaagagaaaccatacctgaccacctcaaatgctccattaaactaatagcaagggaacaaaaatgaaattcttagtattcagaaacacagaagctcataatttttaatcctgtatcagccaagctgctactttaactgtactaagtactgtggaaagctaacaaataaaacagaagacatagtgcttgcccttgagcagattcccgttacataggagagctggaagaaacatgcatacatacacatacaatacaaacaacatgcaacaaactgttgtacagaaataaaaataagatggttaggtgattaacaggcttaaaagaaagaagattaaaatacgactgtttctggagaagtagtttgcgccagaccttggaaaacaagaaaaatcactcctagtgatcttgaggagtacatttttaggagaatggaataatcgaatggtaagggggaaatgcagatggtaatagcctaggtggtaagtggataatgaaacaatagtgcagctgatagaaacagttcagcaaggaaaggaaggagataaacagtatgataatttgacaaaagggcagttgggtcatgttattagtttttttacaaatttttcaaaagaagagagactttttttttttttttttttttctgagatgaagtctcgccctgtcgtccaggctgcagtgcaatggcgcgatcttggttcactgcaacctccacctcccgggttcaagcaattctcctgcctcagccacctgagtagctgggattacaggcgcgcaccaccacgcccggctaattttttgtatctttagtagagacagggtttcaccatattggccaggctggtctcagactcctgaccttgtgatccgcccgtctcagcttcccaaagtgctgggattacaggcgtgagccactgcgagagacttgtgtttgtttgaagacaaagaatgaggagccaatagagagggagacaccgagtatgagtaagaaagaagattgcaaaaagaccaaagtcccagcataagcaggagagaagaggagggaggagccttagagataaactgggacatcaaattggatggcatactgagtatgaaagaggcattttggtattttagaaataagagataggaactgaaaaagaggacacagtaagtgtggtagcatctattattattattattactctctgacatgggttttgtctgtgagaagttttaattcatgtaattgaagatttctgcatgcctaaaaggtagaaatcaaaggctatagcaatatggcaagtctggaggactagtacaagatatgccattccctcattactctcaactatgtcatgggtagttcatcatataattgtttttattaaatgcccaatgagtagctgtcgaaaatttagacagatgtgaatgttctatcctctggggacttatattctaaaataaaggagagggaactggattaactgagctataatcagccatcctgccaccatccaaagttaagaatgatgtgataatgataactgacatataacagtatctaacattgtatgaaatatagaaaatgggcatccctgatgtgtactaccaatcacacattctaaaatactggccaggggatagttcagcttctaggtagcaggtaacattctaaaaccacttggaaatacatcaaaactcttgtgacagtacatgatggtttttgtgtatatgctatgccaattcacactatctaactgtatttttgtgacagctttattgagatatagtttatatagcataatataattgtgcactaatttaaagtgcgcaattcagagatctttaccctattcagagttgtgtagcaatcaccaatatttaattctagaacattttcatcacatcagaaagaaacctcataggcattggctgtcactccatatccccacctccttccaacccctggcaaccactaatctactgtctctatagatttgcctatttctacatttcatatagaatcatataatatacagcaatgtatcaatacttcatttttatggctgaataatattccataatataggtataccaaattttgtttatccattcattagttgatagatcttttgtggattttcacttttgggctattgtgaataatgattctatgaacattcatgtgtaagtttttattagaaaacctgtttttaattctttggagtatacaccaagttgtggaatgacggggtcatatggtaattctgtgtttaacattttatgtttaacagttcttcaactgatgaactgctttccaaagcaactgcaccattttacattcccaccagcaatgtatgagaataccagttctccacatccttacacttgttattgtctgttgtttttattttagccatcctaatgggtgtaaaatggtatctcattgtggtttttatttgcatgtccctgatgaataatgatgttaagcttcatttactgttcttattggtcattagtctgtcttctttggagaaatgtctattcagatcatttgctcttttttcaattatttaactttttattgttgagttgtaagcctccttaatataccatagatacaagccccttatccaatatatcatttgcaaatgttttctcccattctgtgggctgtttttccactttcttgatagtgtcttttgaagcacaaaagtttttaatttttttttttttttggagatggagtctagctcagtcgcccaggcttgagtgcagtggtgcgatctcggctcactgcaacctctgcctcccgggttcacgccattctcctgcctcagcctcccgagtagctgggactacaggcacccgccaccacgcctggctaattttttctattttttagtagagacggggtttcactgtgttagccaggatggtctcaatctcctgacctcgtgatccacccgtctcggcctcccagttcaatttatgtatttttttctttgttatttgtgctttgatgtcatgtctaagaaactattgacaaatccaaggtgacaaagatttatgcctgtattttcatttgagaattgtacagctttagcccttacatgtaggcatttgatccattttgagttgttttttgtatatggtatgaggaagggggtcacgtttattcttatgcatgtggatatccagttgttccagtatcatttgttgaaagtattattctttcccccattgaattgtcttggtgaccttgtcgaaaatcagttcaccataaatgtgaggtttcatttctagattctcagttgtattccattgatctatatatctatcctaatgccagtactcattatcttgattagtgtaggtttgtaatcagttttgaatcaggaagtgtgaggcctccaattttgttctttttaaagattgctttagttattctgagtcccttgcatttccatattaattttagcatcagcttgtctatttctaaaaaaaaaatgagagttggaattttgacagggactgcattgaatctgtaaatcaatttgggaagtactgccatcttaacaataataagtcttttgatccatgaacataggatatctttccatttacttaggaaatatttaatttctttcaattatgtcttgtagtttctcagtatacaaatctcacagtttcttttactgaattattcctaagtattttattctttttaatgatattacaaatggacattctcttcttaatttcactttggagttttcattgcatatagtcatatttattcataaatctttggatttttttgcaattggcaatattttctttcaagagatattttattccaccttgacccatgagtctgagtaaatgtttgaatatgtaacaacttgatgatacatttgtgctttatatcaattttagttttcaccaagaaaagtcaaagtaattggctacttcatgtacccatttgtaatccgtatacagaaacgtctacaaatgtaatttgtattacaccgtgtgagattgtatagcaagtcacaagagccttaagtttggaaactcatttttctgaatgctacctaatggtcaacagaccacaccagaagaactgtgaaactaaagtttttgggaatgtggaagtttttacaacaaaatttaaagaaatccttctaaatagagaattgtgtcttttaaatgatatagcttcaaaaacagatatacagagtcaaaatgcaactcaaaataagtcctttaattaaggataagattttagcaatgccattttacttctacctgagaagatgtaagcaatactaaataagctactgtactggtatctgtagtcttttggtgtttggacataattgtttacacttatacaagtaatgtatttctcaattgtaagattagttaattaacttttctacacagtgagctatctattatcagtgtcatatcagaggattttatttacaaacatattttattcacagttaattgccaaggcctatgtgtgtaaatagttataattcttcctctcaccagtaaattcttgacatctacttactggacatttaataaaaacaattatatgatgacctacctatcacatagttgagagtaataaaaaaagttgtacgttttgactaaaatgtcaaatatattatcaaaattactatcaacaaaaaaattatcaacattactaatttattaatgtatccaagcagtgtttaccaagttcccaccaggcgcaaggtttattcttttctttttctcttgactacttttgggtaatataatggatacaaaagcatgtgtaatccataacccagaaaatctacccctgaaaaattgagagttgaatacatatttctcttcgatagttcacgtaaggaaaattacattaagctacatagatggaaacagtagctttccacctacctttcagatggcttttgctatacccctttgaaccctttaaagcatttaatcacagggaagaggttagttccacctcccattttgctccaagcactgctaatctaaatttgcgaagacttgttactgttaaacaagtattatattcagaggaacataaagaagatgatacttatatcgtgagacacacactaggtctaatttggctgaaaaacacaccaatatcttttaaagattttgagcatgttatagggtgaagtaaaggacaaatatgctctgaatgcatatatttcttctctttggaaaacatagcttagatactttgtgaaacttgcaaatgtctttaaaatacaactcagattgctgttatgggctataccatagcctttaacttgatcatttttaccttaaaatgtaatggtggaatctttttaatgaccatgtttcactatcttctatcaatattcaaccgagttttgcataggatcattgaatgtaccacgtctagctatattaaatagaaaaaataaatatacacatatgtgcagaatatagttatttacctcctattttatatgaacaatgtcattagtaatcatgtaattagtattcaagtgtgtgtctgagtctagatataatggagtcttgatttaggtgataccgccactgcacacattgtctgtcaccaattccaggcccctttttttttcaccttccaagtatcttgaccttttcttttggaactgagttaccatcacttagtgtgccctctttcaacacagcctgtctaccattggtttttcctgctcagcagttgatgcctgtgttgcaacctataaagagagtgtttagctcaaactaaattggtggatattggtgagactgtgataactacagtactgcacagcttgatatgatctgtggctctctgcatttaatctcaaatttgtgcaaggaagtgttctataactggagaatatggtcttcctaggttttccagtatgctttagtaaaataagagattaaatgccaattagaacaggcatattgcaaaaataaataaaattgtacctggatgctgtattctatctctgctgtttacaatttgcaaacaaaggatcagagtcagtgttaagtttggccaaatagatcccatttacctatattaatacagaaatttttggaaaaaaaatccttttttttttaactggagacagggttttacaatattggccaggctgatctcgaactcctgacttcaggttatccacccgccttggcctcccgaagtgctaggattataggcatgagccaccgcacctggcctcaaaaaatactattttgtattgtttttctacatttaatttccttctctttagtttgccacaccttttggctacattaaggaaaatagttaaataatgaattcatagttattgtactatagtctataacaaattttgagagatgataaaatggagcagtctatttagtggtctagattgctaacagggaaatatcttcctttctgatgcatgaaactctaaagggtaagaggctgagaaattttccacctacaagctgtgagaatgtctcttctctaataccaaatcaccacaactagcttgctttgcctatttttatttaaattacagtccacgtgctcattcgtatgttgtcatctctgttcatctaccttgtcttagctgtaatgaagctttcaagggatgagatcaacttcttttaaaattattttcatgaataacttatgcatatgtactccagatacatagacttgctaataaacagagaagcccaacaacacaacttcctttcttttgatttattgaataacatttaagtagcttcattatgtaatatatgatgctataaagtgcagaataaagagatggtgtagtatttggtaaggttttaatataaaggttaatgtccatcaaccagttttgttcagatttttaaaaaatgacaatatctattcattaaagtctattcttagcacctttaaaacagtgtttgtcaaacctagaacattttgaattgttttatatttataatattgtttgcataaccaaatgatgcattttaagattgataaaagcccctaatgaggatagcagttgaataaactgaacattaacttgcgaacagaagtgccacataaacatggtctgttaattgtctgctcattgaagacattgtcagctctaggacttaagagttaaatgtataatcagccctttaggggccaaattgatctgtctcacatggaaaaaagtaactttcagtgaaaaataaggtcctcagttggtcatttatcatttcaaagagcctattttattataaatgtcaattccacaaaattatgtgtcctgtaatacataattatgtacaaaattgcatttgaaatctattattaacagttaacagtgaacattcttaaaatagttattactgttggccttaacacaaaaagcaataatggaggtattttagggagttaaaagctgcaaggcattggccactgaataaagccactgcaggtgtgtttcttaatgggctgttaactttataatgggtgagcacaaagaacagagaccatgtgtgttttaaaactgtgtttggtctggagaaggagttgatggctgaaaaaaataaaggtgatgtgaaatgaggccaagttgagctttctcacctgagatgtaaccctccttgcttaaaatcaaggcaaactaaatcttgctcctcctcttgtattcctaccctccccattaccacaaaacaaaaaattccatgaaaacacatattaaactggcacatcagaaatcattggaaaatatgacaataaataataaagctctgattgcccaaactcaacatcctccctcacagaccagctcctgtttttgctattagcactgtctaaatcccccaactcacaatcacggggttagctttgaccctccattggccccaacacttaatgttctctagagctttgcttctcagggtgtgggctgtagaccatgcgacatgggcatcacttgggaacttgttaaaaatgtctgactttggaccttctgaatcagaattgtattttaaaaaactgccttcttgtacgcattaaagtttgagaatctctactgcagtatcttccttagcattgtctctcatatcttctccttctttccattcacatgaaattatttttcactgagatgtagtttttctatatgagctgtttgggcataccctaaatttagatcttcatgtcatttcacttgaatcacccataattcctatgtcattcttgtgtccgtctgctctaattcgtcccacctctgcctcaagattagcctttctaatgtacccaaacctcttccctcttctgaaaaacctttaatggctttctatcctttattaaataaacccttttgactggtcctctaggccctagacaacatgatttccttcttccctccagccctaactccaactgctcctctctatagacacataccctacaccttagctttacagtttctttcctctttttagttcaagccatcctttccatgtgcgccactcttcccaataactcttttgaaatccttgtcctcctctaaggctcatcttcagtgccacttcccatagtaactttttctcattcatccatttgttctatgaatacatatgtatcgtctatgttctttgcctacagttgcctacattgttctaggtactgggaatataccgacgaataaaacagccacagtgcttgtccgcacagagcttactttctattgaggaaaaatagacaataaacaataaataagtaaaatatgtagtatgttagatggtgataagtgctaaggagaaatacaagaagataaagaggatagagatagctagagatgaggagtatcctccaaccaaataactttccctctttcaaatacacagagcacttatttttctttacagtgaggttatatgtgcttgtcctattttccctattttcaatgctccttgagagcaacaactgcctcttactcatctttgtatctcttgcagctaccaagacagcactcagtaaataatggttaaaaggagtgaaattgattgaaataaatgcaatagggtttgaagagaagagagagactgacatagtgggtggttggggaaggcttcttagatgatatttaatttgggcaaggccttgaaagacagatggggtggggaggaagaaaaagctgagtaagttattttgatatatctgttcttgaaaagctaaaaaccattgctttataaattaagattaacatggtgtgtaattttctctacctttaaaactagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcaggtatttgatattataggtattttcttaaacccttttcaagggtgatgggttgaacagttcagggtttgtgacttatgaaatatgtggttgtcaaaggtaaggacagaaaaatatttgtcatgaataaatatccagaataattacactgaaactaatgaaaaaaatgacatggagaaataaggaataacatttagcagagcagattcagaaaagaaagtttaagacacaccctttaaatttgacttctgcttcctggaaccggctgttcatgagcttcccagacctctcatcttgcttagctttactgcccacagtcccttcactgatttcatacatctgtgtccccttttcccaatgaaggaacgcatattaatcagaaattagtgagaaattagtcaaaaagttaggttttgtcttacaggtagaaatttttctttactgttgttaataacttaaatgtgtaaaacttctatgatttttatagcccttccataaactttaaacatctcatttctcttattttcttctccttattttttccccacatgaacccatttcgagcactacttcatctaagaagtagaaaaagtgatcaaacactggggcttgttttttccccaacagatatgactatagttaaaaccttaccttcagttagtcaagagatcatgctaaacaaagaaacaaactaaaaaacaaccttaccttctgggccagaatagaaacggaattagaatgcattcaaatgtgattcaaaaaataaatgttcaaggaaacatgtgccaggtccttgtcaactgattagaaaaaatggagaggaggggccttttgaatatgtaaatatgtcacccacaaacgtagtaaattatgatgaatgttctcaaatttttgactgttcatttattttaaagactatacaactgtttttaatttgtagagaaggtcacagtaacatttatgagtggaaggtgtattttcaagtatcttctatcagatgctttagtaaaatgtcaagattctcctgcataatactaaacaagatttctttctgttttttatttattcatttttaaacaattattttgaatactctcaaactgaaaggtttataatatttttaattacagtgagggtttcttcataattaataatatgtttttgagtttaaatatgctctttaaaaaacttttaaaaatttttataaaatttgttgcccaggctggtctgaaacccttgggctcaagtgatcttcctgtcctcgcctcccaaagtgttgggattacaggcatgagccaccgtgcctggccaagtctaaatatacttaaaaattgataacctcctcttccaatttgctcaacttcaaagcaaagaagtaagaaatagggcagttgaagttagggatgtttatcagtctagaagaaaaagtagtggctcatcttcatgtttgtatttgttccagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattggtaagctgctttgcctaatatgttgaattgacagttcaaccctagaaagacacaatcagtgatgacagtgtcctgggggttatttaagcttattgctcactttgagttgaagtcattattgaggaaaggttactatgataaaagtttatattgttgttatcattgatgttgtttaaatgctgattaagattttttttaatgctactttatttgttgctcttctaggacacttgccatacatctttttatgtgctctcaacagaaataattaccttagtaatattattaccaaggctacatagatgaacaatttcagtgaaaaagggaataagcaagttaatttaagttctgttatttttaaaaagcaatgaatacctttttcaaatagaaaaaactagtatcagtacagttcttctttagaacaactggttctagaagcattagggctttaaaatacaacataagattatttacagaagaatattaaggataataacttgagacattcaaagccctttcttatagaatattttagtttgaaattcatcacaatgtctctttcagtgtgctcagggccttttaaaacatgttctttttaatgcgatgcctgcctatactcattcactttcaccctaattagtttcagacgtctcactcttttgtcattttaggataaatagtcctcgtgaccctttgtgtgaataaagctgagctccttagcaattttagagtcctgaaaataaacaactcatagacacagtatcgtattgtgtgaatt

SEQ ID NO: 1139 - DNA, 553202 bp, mus musculus; identical to SEQ ID NO: 1138

SEQ ID NO: 1140 - DNA, 27912 bp, mus musculus
gggaggaacatggcgcaagctctgtctgaggaggagtttcagcggatgcaggtgccgctcgcggtgggaaagaccacccggctaggcgaccgggggcggggtagcgagaggtcgtgctatcagctctgagaaggggttggttgggatggaccctgagtttatggggtgggtctggagaagggaaactgaggctcggagtggtgagactattggattccgagatactctgcggctttgaaggttggactctgttagcattgtgggctgggagagcgccattaagtaggcggtaccttactcagacctggaggggacgagacttttgggcccgtgcaggggacaccgtcggcgggtgatgataatgggctttgagggaaggagatcctgagaaggcgaaaccattttgtctggagaggaaggaagcgggtgttgggtcgtttgcgtcatggtggtgggagcccttgagagggcagaaccattagcgggtgggaggtggtaagttttgggggagataccactgtgcccggggattggggaaagaccccagatgttgtcattgttcctgggaggtggagatcctgtgccattggtggttggtagtgcatcctaagagggggcggcaccattggatgattaagggtgatcccattaggcctggggtgaagaaggccatgaatgggtaataccattaatcccattaactggggggaggaccagaggggtaaaagattgataccttggactacaaggagggaagatcactgggctttggggaggtacccccacttgattcttttggggggactctgagatgcaatgaaaggccatagcattgcactatgaatgggcccttgttgagagggttcctcactggggggggggtctgaacagggtcctgcatggggaggggaggaactctgagggaggacaggtaatccaattggtccttgaatgagggaaaccagctgtccctgtgtgagggacactgagaatggaagggcgagttgattaacccatgaatggggaagaccactgtcatctgaaagggattctaagtgagtaagagtcatccaactggcctacccaaggccttgtagaggcctaccctgaagggtgtagggccattcccaatggatcatgactggggagatcttgaggggagtgggaatacccttgaatgaggaacattgatcccactgggccatgaatgagggagaactactgggctttgttggggggcaagtctcggggggtacaaaggatattccacttggaccagtacttggagagacagatcactgggtcctggagaggacaggagtaggaaagattctgtgaaggccaagccctctgaccttgagcagactaccagagaacagtgagtggaggctggtggcgtgggagggagggaaaagtcctggtaggggaaggaacagtaagttccttaatgggaaggaaccggccttgctgggtagaaccagcctcagggtcctatagggctggtagggaggaggatgcttaattctttttctttttctttttttttgagacagagtctttctctgtcacccaggctatagtgtgcagtggcacgatctcagctcactgcaacctccacctcccgggttcaagtgattctcctatctcagcttccctagtagctgggattacaggtgcgtaccaccacgcccagctaatttttgtatttttagtagagatgaggtttcaccatgttggccaggctggtcttgaactcctgacctcaagtgatctgcccactttggcctccgaaagtgtttggattacaggtgtcagccactgcgcctggcactttcccttaattctttttttttttttttttttttttttttttgagacagagtctcactctgtcacccaggctggagtgcagtggcacaatctcggctcactgcaacctccacctcccaggttcaagcgattctcctgcctcagcctcccgagtagctgggactacaggtgtgcgccaccacacccggctaattttttatatttttagtggagacggggtttcaccatattgggcaggctgattttgaattccttacctcgtgacccacccgccttggcctcccaaagtgctgggatgacaggtgtgagccaccgcacctggtcctcccttaattattgaagggggcctggatgtattttgagagccttggaggtggggggaccctggaaagccccctgactcaatgaaagttgggcagaatacttgacccttttcccttaggaaagagggaggaagacaggcccttaaccccctgccatcagaggcccccaggtctggtcagaaatatggacaacacccctgacagtgtgtgttcagtgtgtggagaggtcagccaggatgaggaggaggaactttatcctgtgggcatggagagccagggaactcacacaagcaagaccctgactgggggcagtgctctgggatggcctgagtgcagcgtggattgtagtgtgagatggaggggtgaggctggctggggttataagtggagctggaaaaggtgagccagggtctgagggcctggaaggtcactttgggtgtagcacatacaggtcttaaggagtagctacagaggcacatggagggcgtaaggtctgtggagcttaggggcttggttccctcatggtaggggtaggggcgctttcctgaccaagtcttttcccttcctgcctcccccaaaggctcagctcctggaactccggacaaacaactaccagctttcagatgaactacgcaagaatggtgttggtgagccaggagggccttattagatgggggtggctttggggaatggtgtccgaggttttccctcagaggcctggcaggaaggcctttcagtttcttgccactggctgaggctgagtttccctgctttcccgacaccagaactcaccagtcttcgacagaaggtcgcctacttggataaggagttcagcaaagctcagaaggtacctccctccacccacccatccacctacccatccacccttgcttctacctatctgactcattcatccctccagtgagcacctacagtgaaccagacctaatgttgcatgctgttttcacgtagtcatttaaaggattctcaatggaattctctttagttgctaattttacctaatcctgcttaatttagtgattaattttaatttacttttaattcatttctaatttcagttactcattctcattcactgacttttaattaaatattcaaatctatcagtaaatctacctcgaatctgcctcccatcctctactcacactcctgccttgtgctcctacttcccatctctgtcctggtccagttgggaaaatgagagcaaacccacctctcagatcctctaaagatgagataggatataacctattgtggcccctcaagacattcgaggtgctcctttgtcactgctctgtccccatatctagccatacctagcacaatgttaatacataatatgtgctcaataaatatttgttggatgaacgaatacagtatgcagaaaatccgacagtcaggaagctgcacttctctttggtaggatgctgattcccctaagctggcaatgctcttggctgcccagtaggggagcgacagtttccacactgcgtgggagggacccacagagacatgtatggacagatgtagcaatgaagccacagtttctgagtctggagatccagcccataaatggttaaataccagggcatctccctacctcccctgtccccccaccagcctcaagagcttccaagaaaggatgatttatgtgtgctggggccccagggcaagacttgcattcattcactcactcacacactcattccatcattcctttgggctccaaattgtcacacatgttctgtggttgaagatgctcccatcctgcaacccctgtcatccttgtcctcccaaaacgcttggcacaattgtctccatatcctagtaaggcagtccatctctgttcactttagctctcttcccacccacccccactttaggcactgagcaagagcaagaaagctcaggtaaggggatcccttgtgggtgagtgtgactgggagatgtcttggtgggctatttctgtatgctgatatttccttgtactggcctttctttctttgtgtgcctttacatctgctactacctcactgccatgtgttgctgtatctgtccttgtttccctgtatttgtcctaactctgtgtctctttccttctctctctttccattcttttctctgagtctctttctgtctctgtctgttttcctgttcctgtctctctgactcatttctcttcccaatcttctctttgtctctccccctcctgttcctgtctcggtgatttctcttttttctgctttctctctctaactccttgtttcttccaccccattcctctctcttcctaactcatttcttttcctgacccctcctcttctccctgttctgttctctccctgttgatttctgtttgttcttctctccgtctttttcactctctccctcccaatccctctccccttttctatctctccccctttccccatctctacttcctctctccccaatcattatcttcctgtcttttcctccgctctcttcctccctgtattcccttctctctaccttcccatgtctttatcttcctttccctgtctctcattttatccctccccatgtctctttctcctatatcacctcattctctgtaccctatgtcctctcccacccatgtcattttctccctctctctgtttctttgccctacctccctatcctttttgcccttgctggagtcctggcccttgtctgccactgcaggaagtcgaggtattgctgagtgaaaatgagatgctgcaggcaaagctgcacagccaggaggaggacttccgtttgcagaacagcacactaatggccgagttcagcaaggtgctggtgcctgggatagtcaaaggggaaatgaggggtaggggtcatctgggctgaaacctaacagcggcagagagtgattggacagggtctggccctggagcactgtccgtggtgctgaaacaggtcctggattgctgctggggggcagtaatttgacagatggggccgctcactctgctgggattagaaggctttgagccctgaggtcacctggttcctggccaagtcactccttttatttgagcttcaagtctccatgtgtataatgtggggttgatgctgtggtgctccaaggtgttggggggttttaggcagagttcttatgcttaatataggatggaaaagtgttcgagcttcttcccttttctctttcttctcttcatctgacatgagcctggggttctacctcttccagataattcatcctggagctactaattctatctccccattgattttagtgtcctgtctgtttctaaatctactgggcagttggagacattgtcttttgttccctcatctatcttctgtatccacagttgataattgtctatgtttttagtgtgttttaaggaaaaaagtctcatggcagcaaatttttttgagatggagtttcactctcattgtccaggctggagtgcaatggcatgatctcagctcactgcaacctctgcctcctgggttcaagcgattctcctgcctcagcctcccaagtagctggaagtacaggcatatgccaccatgcctggctaactttgtatttttagtagagatgagagaaaatgacatgggtgggagaggacatttagtagagaaaatgaccatgttggtcaggctggtcctgaactcccgacttcaggtgatccacccgtcttggcctcccaaagtgttgggattaaaggcgtgagccaccgcgcccggcccaaaaatggtatttctaaggctccatctgagaatatagtgcctatgaccttaaaaaaacaaaaccgaaaataacctttaagcaggtacaataccaggagaggcagttgagcaagtagtaggtaccagcagggactctggaaccagaaggcctagattaaaatcttggctctaccttttactaactgtaaccttgaggaagttacttaacttgcctggttcttggttcccaaatgtttaaaatggaagtcatgataataacagtacctgcctcttcacagggcttttgtgaggattaaatgaataaatgtacgtaaatcacttaaaacagagccttgcacatagtatcagctatggaagcattagttataatattatccttctattaactcatcttccctctaaaatatttgactttttaaaagttttatggccgggcgtggtggctcaggcctgtaatcccagcactttgggaggccaaggcaggcagatcatgaggtcaggagatggagaccatcctggctaacgtggtaaaaccccgtctctactaaaaatacaaaaaattagccgggtgtggtggcacgtgcctgtagtcccagctactcgggaggctgaggcaggagaatcgcttgaacccgggaggcggaggttgtagtgagccaagattgcaccactgcactccagcctgggcgacagagcaagactctgtctcaatttaaaaaaaaaaagttttatatccaccctgtggccctgctttgccttagcctctaccacttatcatctgctgtttctacagccgcctccctggtctcttcacttctagtttcttctacttagttcacaccacagaggctgttctgacctgcagatcttatgacatcactcctttacttaatacattccagtgccccagtcctgctcctagttcagagcccctggtattcacataactgctggcttcactgactgactcctcactgcttcctgcctccagcctccatggtatcatgattcttgcagagtgaggcaggggcagacattcttccataaatccagcttgtttccctgcatctgccctgggccagcactgggctagtcgtagagacttcctacatagtccccttcctcctccaactcctcccaggaactggaagtgctctcagagagagctacgttaaacctgccaccaccccttattcatcaagacatttcagcttaattgttccttcgacaaatagttactgagtacccaccacatgctctatgttctggaaatacagttgtaagcagcacagaatgatctccactcttgggtagcttacattctgggggtgggatgaggagaaagatgataacagtaaacaaataatactagtagtgatagctgacatttatatggtgcttactgtgtgccaagtcctgtttgaagtactctacattattcactcatttaatctttgaaataagcctgtgagatattagtatccctatctgacagatgaggaaaactgagttccagggagattaagtaatttgtcacacagctagtaaatggcagagcagaaattcacattcaagcagtctggtttcagaatctgtgcttgttacaaaagaaaattttgattagtactaggtaagaaagaaatgaacagtgctgtgacagagagtactggaattttctgtgttgagggatactactttaaaggcaacatctgagcagagcactgagggatgcaaagaagccagttaggtgaagaactggatgagaggattggtgttctgggtagaaaatattgcaagcaggccgggtgcggtggctcatgcctgtaatcccagcactttgggaggccgaggcaggtggatcacctgaggtcaggagttcaagaccagcctggccaacatggcgaaaccccgtctctaataagaatacaaaaattagccgggcacggtggcgcatgcctgtagtcccagctactcaggaggctgaggcaggagaatcacttgaacccgggtggcggaggttgcagtgggctgaaatcgtgccactgtactccaggctgggtgacagagcgagactccatctcaaaaaaaaaaaaaaaaaagaaagaaagaaaatattgcaggcaataaaataaaaattctctgtaggcctcgatattctcatctgaaaatggggacaaggaattttctcaggactgctttgagaagtgtacttcagccaggagttgggcagggggctggcttagttgtattggcattgtatacctctccaagactaacggctggcaatgcaggagctgtcatcagtgttggccctggaaatgccctgcgagctctttgtggtgcttaggatgagagggagctatctctgggcccaggatccagccctccacagaagaggggttgcagtgaggctgtctgtagcactaacaacttccagaggagcctgaggtcttggattgcatctctgaggttgggagtaggaagaggaaaatggtttttggtgtcctcatacttggtatgctcttggtattctctgactctgccacttaaaagatgtgtgaatttgaacttgtttaacatctctgtgcctcaatgtccttatttgtaaagtgggagggcacctatatcatagggtcattatgggaattaagtgaattgtaaagtacatggacaaatgctatgtaggtttcagcaaatactgctctgattctctgcttctctgccccttctcttcctctgttcagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcaggtgcatagaggccctcctggggatgcggagacattggggcttgagtagggcaaggaaggccgtcatcctctcaggggaaggagaagggcttcagaaatagggttggcccatgccctgtgtggctttggacaagccatttcacctctctgagccaaagccttatcatctacacagtgcatgtagtgatgtctgtcacccagaagattgtagtagagataaaaggtgatatcattctgcattagttcagtgtctggtacctagcagatgttacagattagcagcttgaatgtcaaaaaggagatatttgcggccgggcgcggtggctcacgcctgtaatcccagcactttgggaggctgaggcgggcggattgcgaggtcagcagatcaagaccatcctggctaacatggtgaaaccccgtctctactagaaatacagaaaattggccgggcacggtggcgggcgcctgtagtcccagctactctggaggctgaggcaggagaatggtgtgaacctgggaggtggagcttgcagtgagccgagatcacaccactgcactccagcctgggtgacagagcgagactccatctcaaaaaaaaaaaggagatatttgctaagtgaaaaagtgaatggagtgttgggaagattctgagcccagattgtaagtggggtctgggatgaaagctgaaagaaagcttgatagagtgtgggagcatgtggtgtgtggaactttggagagcagctgggacttctgtggtgatggatgctggttccatgaccaggagggagacttagtagaatgtgagtaggaattaggaggctctaggagggattcagctgtaagtcagtggtagcatatggtgggcatggccttcaagggctatgggtggggcttcaaggattgagaatgggatttgtgaaaccagcttgggctaatttaatagtaaacagaatcttagtggttgatagggcttaaaatatttgtgagagcctgggcacagtggctcataccttgattccagcactctgggaggctgaggcagaaggatctcttgaggctaggagtttaagaccagcctaggcaacatagcaggaacttgtgtgtactaaaaataaaataattaggccaggcacggtgtttcacacctgtaatcctagcactttgggaggccaaggtgggcagatcgcctgaggtcaggagttcaagaccagcctggccaacatggcaaaaccccatttctattaaaaatacaataattagccaggtttgatggcaaatgcctgtaattccagctacttgggaggctgaggcaggagaatcacttgaacctgggaggcagaggttgcagtgagccgagatcacaccactgtactccagcctgggtgacagagaaagactcagtctcaagaaaataaacaaataaataaataataaaataaaattaactgggcatggtgtgcacttgtagtcccagctacttgggaggatcgcttgagcccaggagtttgaggttgcagtgagctatgattgcaccactgcacaccagcctgggcaacagagcaagactgtctagggaaaaagatttttttgagacggagtctcactctgtcacccaggctggagtgcaatggctcgatcgcggctcactgcaacctctgcctcctgggttcaagcgattctcctgcctcagccccacgagtagctgggattacaagcgcgtgcgccaccacgcccagctaatttttgtatttttagtagagacggggtttcaccatattggtcaggctggtcttgaactcctgacctcatgatccacctgccttggcctcccaaagtgctgggatacaggcgtgagccaccgtgcccagccacggaaaaagatttttgggggaggctgaggtgggaggattgcttgagctcaggagttcaagaccagtctgggcaatgtagcgagaccttgtctctacaaaaaaatcaaaaaattagcccggcatgatggcacacacctctgatcccagctacttgggagagtgaggtgggagaatcacttgagcccaggaggtcaaggttgcagtgaactgtgatcattccagtgcactccagcctgggtgacagagcaagtccctgtctcaaaaaaaaaaagaaaaaaatgtgagaggcatggatagagctgaaccttcgtcttttaggcatgtggtcatttggcacagggactctgccacctgaggggttgaaggccagttctccctctattcgaggcatggcaagggacttcagagaccacctcatccatcatatatccctgttctactcaccagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagaggtgaatctgagtctgttggagctggaatgccagaaggcagggcagatgttctacctctgtctatagtcccacggagatggctgtgacatcaccatcttgtgggctgatggggtgagggaggcaggagggcaggggaaggcttctccttgtccttgctaacaacaaccctcccatccctcatccttccctgcagagctcaaagcaggccgaaacatccaggctgcaggaggaacttgctaaggtgcggctgcttggctctttcccattctgctcccaatctgctggattctttcccattccattcccaatcctagggcagaaggggcattgtaccccatcaaagcctaggtttcatcatctgtgaaatggagagactcacacctatgtctcagagttactttcagtatggaatgagttaatgtggtcccactatatcttgtgcatgataagtttcatcccatccatctctcagctttgcccattcactcattcattcattcatgcaagcatttacagactcctggctcttatcttaggacctggagacccaggggtgcggcacccagtcatgatatcctgctttccaggcctcccagcctagccaatctataacatggccattggccactatgttgggagcataaataccgggctttggaacctgaaggatctgggtggagataatattgttgttgctgacccgctgagcaaccaaattacttaacctttccaagactctgtttccccatttgtaaaactggtactactcacttgtcagggctattttgaggattccacaagacaacataagtaaatcctggcttccaaaaatgacttaataagaagtgtctatatttattaattttaggtttgtctttatattattctcaatgttatcacttgtctgtacctctctccccagctctccgagaaactgaaaaagaaacaagaaaggtaaatttctttttcccaagggtactgggggccgaggggggaattaacttacggaactgacccatctacatctgtccttctgtgcccagtttttgccgtctgcagacagaaaaggagactctgtttaatgacagcaggtaactgccagatttgcgggtattggtggacaattgggacagtgcccagtgaagattacaggggcagagctaggagactgggcctcaagccatgtccaacacaccccctccccatcactcctaggaacaagattgaggaattacaacaacggaaggaagctgatcacaaagcccagttggctcgaacccagaagctgcagcaggaacttgaggctgccaatcaggtgatggggactgggttctgagatccctggggtaggggccaggactgggagcctggagaggtctgaggtccatggaggctggctggggagtctgagatttcctgtgttggaaatgggttctggggccccccaggagctaggaaaatgggaattggagagccctaggaattgttataggagtcttcatgagtgtaagatctcagggggctaaggacttagggggctgtgtgctataagtttgtgtaaatctgaaactcctggaggtttgagaccacagtctggatgaatctgtggtcactagggcctaggaccaggaactggggtaagtctgaactccctgggtgctgggtgactttgaaatctttaggggctgggatgtcagtaaatttgggactcccaagggctgaggacatggctgggtagatatacaactttcaagggtgagatagttggggctgaaggctgagtgcatttgagatcctcaggatctgggcgctggcttgggcctaagacacctaggaagtgggatcatatgggctaggtagtcctgagatccttgagggctgtgaacaaaaagctggtcagtctgagacctccaggggctggagcagaagtttaggtgggtctgaggctcctgaggactgggggctggatggttctgaagcctctgggtttccttctagaaaaggtgagtctgaggtcccttggaatggaggatatggtggcttgtggttctgaagtccctagaaactgggaacatggggtctgagacgggagtctgggtaaagctgagacccccaggaactggtggttaactgggtctgaagattccaagagactggggagcagagtgacaggtgaaggggtcagtctgagagttcaccaggacctggaaactaggaggttgtgagtttgagacctctaggatctgggactatgagtttgggtggatctcacctgggaagtagggacgtgggagatgagtgtgtctgaaacccctggtggttgggattgggaggctgggtgaaactgtcatccttgggtgctgactacatctgagatccatggggctgactgtgtctgagaatcctggagctcccaagctagaatctgggtgagtatgagacttcttatggatgggagctgagtgagtttgaaccgcgtagcagctagggccaggagtctagtcgtgcctgagatcttgtacgctgggatagaggggttgactgtgtctgaggcccctgagggtagtgacctggcgtctgggtgaacctgagattgctgttggctggatagtctgagacccacaggtgctgagaacatgctgctgggtggtcaaacagagagtctgtacggttatatgcaccccaggagaggctgaggtgtaaaatgggctcccctggtctccacagagcttggcagagctgagagatcagcggcagggggagcgcctggaacatgcagcagctttgcgggccctacaagatcaggtatattgtactgcgtgggctcagggagctggggttcaggatgggggcagcctgagtgggtactacatagtcaggcaaggtcccagggatcctgcttcccccaggccttcgtgtgtgtgtgtgtgtgtgtgtgtgtgtgtgtgtgtgtgtgtgtgtgtgtgtgtcctttctttcttggtcgtgggtaggtcctgtccccctgttctggacccactctcacctgctgtggacgtggggccaggtatccatccagagtgcagatgcacaggaacaagtggaagggcttttggctgagaacaatgccttgaggactagcctggctgccctggagcaggtaaagaacacctgggggcccttgctgatccctctccagttcccccatctccatctgcttctggtccacatcagggtagggtggtctggaccccatgctgttctcctgtctttgtttctgttgctcctttctgttggcgtccagccctcttctctctggccatccatccctacttttttttttttttaacttttaaaaattttattggggaggctgaggcaggagaattgcttgaaccaggacccaggaggcagaggtttcagtgagccgagatcgcaccactgtactccagcctgggcgacagagcaatactctgtctcaaaaaaaaaaaaaaaaaaaaaagggcgtggtggctcatgcctgtaatcctagcactttgggaggccaaagatgtgtggatggcctgagctcagttcaagaccagcctgggcaacacggtgaaaccccatctctactaaaatacaaaaaattagctgggtgtggcggtgtgtgcctgtaatcccagctactcgggaggctgagacaggagaatctcttgaacccaggaggcggaggttgcagtaagccgagatcgtgccattgcactccagcctgggcaacagagcgagactccgtctaaaaaaaaaaaaaaaaaaaaagccgggcatggtggctcaattctgtaatcctagcactttgggaggccgaggagggcggatcacctgaggtcaggagttcgagaccagcctgaccaacatagagaaaccccgtctctactaaaaatacaaaattagctgggtgtggtggtgggcacctgtaatccaagctactcgggaggctgaggtgggagaattgcttgagcccaggaggtggagggtgcggtgagccgagatcgtgccattgcactcaagcctgggcaacaagagtgaaactctgtctcaaaaaaacaaaaaacaaaacgaaaaaaaacttattggccgggcatgatggctcacacctgtaatcccagcactttgggaggcagaggtgggcggatcacctgacatcaggagtttgagaccagcctagccaacatggcaaaaccttgtctctactaaaaatacaaaaattaggccaggcgcagtggctcacgcctataatcccagcactttggaaggctgagacgggcggatcacctggggttcggagttcgagaccagcctggccaatatggtgaaaccccgtctctactaaaaatacaaaaaaaaatagctgggcatggtggcgcacacctgtaatcccagctactcgggaggctgaggcaggagaattgcttgaacctgggaggtggaggttatagtgagccgagattgtgccactgcaccccagcctgggtgacagagtaagactccatctcaaaaaagagaaaacaaaattattttgtagagacagggtctcactatgttacccagactggcttaaacttctggcctcaagctatcttcccacctcggccttccaaagtgctgggattataggtgtgagccactgtgcttggcctatctctgctttttttttttttttgtagacggagtttcggtcttgttgtccaggctggagtgctatggcacgatctcggctcactgcaacctccgcctcccaggttcaagcgattctcctgcctcagccctcccaaatagctgggactacagccgtgtgccaccatgcccagctaatttttgtatttttagtagagacggggtttcaccatcttggccaggctggtctcgaactcctgacctcatgatccacccgcctcggcctcccagagtgctgggattacaggcatgagccaccgcgcccggcttctgcttttctttgtttctagtttctctctagtaaagtgcatgaaatgtactaatcttaagtgtacactcagtgaatcctctcttcgtctctctcttttttttctctctctctccccgccaccatagccaccacccagatcaaagtataaagcacttttagtaccccagaaggtcccctttaccccttcaaagtcagtactcccccagaagtaaccattattctgatctctagcaacataagattcatttcgcttgttctttaacttcatataaatggaatcagctgctctttgtctctgacttctttctggcagcactatgtaagtttatccacgtggcagcacagatctgttctcttactgttgtgtggtattccattgtatgaacataccacatttacccattctcttcattgtttttctgtttgaaatttcctctctcttcctggttctcttcccacctccctccctgtttccctggaactagggggctcataccctgtccctggcccctggggtccctttcactctacttctcatcaccactactttctccagatccaaacagcaaagacccaagaactgaatatgctccgggaacagaccactgggctggcagctgagttgcagcagcagcaggctgagtacgaggaccttatgggacagaaagatgacctcaactcccagctccaggtaacacctttggctctggcctgtctcttcctagttccctagtaatggcccagtgaagtccccagtaaggtggagtgggaagactggagtcaggaggacctaggttccagtctggctccctaacttattagcacctgtgtgttctgggacaagtcatttcacttctctgaaactgagcctcttcagttagttaggatatcaattctttttcattttttaaattttaatttaatttaatttttttttgagatggagtcttgctctgtcacctagtctggagtgcagtggcgtgatctcggctcactgcaagctccgcctcccgtgttctcgccattctcctgcctcagcctcccgagtagctgggactataggcgcctgccaccatgcccggctaattttttgtatttttagtagagacggggtttcaccgtgttaaccaggatggtttcgatctcctgacctcgtgatctgcccgcctcggcctcccgaagtgctggtattacaggcgtgagccaccacgcccggcctccttttttttttttttttttttttttgagatggagtctcactctgttgcccaggctggagtgcagtagcgcgatctcagctcactgcaacctccgcctcctgggttcaagcgattctcctgcctcagcctccggagtagctgggattacaggcgcctggcaccacgcccagctaattttgtatttttagtagagacggggttttaccatgttggtcaggcttctcaaactcctgacctcaggagatctacccggctcagcctcccaagcaatatccattctgattccataatagaaaccagaataatagtagattaaataagatacaaatttagttccctctcattaaaagtccaggtaggttattcagggatggaatgatggctttccagtcatctgtgacccaggttctttctccattgctgttcctccaccttcaacacaagacttttatcttggcatccaagacggttgctgaaactccccgaccatcatgtttgtattctatctggaaggaaggaggaaaggggcagggaagagtgtgcccctttcctttaagagcataacctaaattacactcaccacttccacatacagaaataaatcacatggccacacctaaccataagggaggaggggaaacatctgctagacagctgtatgcccgatgataaattttattgctagggaagtaaggaagaatgaatactggggagcaactagcagtctctgctatatttcctatccagaaattgagatcacaataccaactttaccagggagaagggagatggtctaccagatggtcctgggtgactagcacctactggatgctctttatcaaactctttccctttggtgtctgcattaggagtcattacgggccaatagtcgactgctggaacaacttcaagaaatagggcaggagaaggagcagttgacccaggaattacaggaggctcggaaggtaggggaacatgagggttgaagggagaggatggggggtaggaattggctcagtccatggggatgggaggaggtgatataaccaaacatgtggggataggagggaaaggaaaattgactggtttctggttgaccagtttcttggccaaatccatgagagtgggaggggaaagaaagaaagtgaccagttctataaggatgggtgagtgccttagccagttcagtggggatgggagggagtggagtttggctagttccttgggcatgggaagagggttggaggccttttttcgatgttgtggaaggaagttgactgccatcgtcctggcccccagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggtgggtgggtagatgatgatgcccttcttcctctaaaacctgggaaccacagcgttgctgataggccagtgggtggcatgcatcaggtgcccgctcctctgccttcctggcccatgacagtctgccccatcccaggcccggacacgggagctggagactctccagcagacagtggaagaacttcaagctcaggtacattccatggatggagccaagggctggtttgaacggcgcttgaaggaagccgaggtgagttggtgatgcctggtgaggaacagaggctgattggggccctcatgtcaaaccacagaagcaggagtggtcaggccctggaacttcccgagattttctggacttagggatatccccacagtcccctggctcaatagcagccctctggagtggatcaggggatggccatcagataggacagactgtcacgtgttaaggctgccctgcctttgtgcaaatttggaaaggcacctctttctcctgaaactgtacttctgtcaggaaattaatgcaatacactgatgttattgaacaagaacctgctgggtgcggtggctcacgcctgtaatctcagcactttggaaggccgaggtgggcggatcacttgaggtcaggagttcaagaccagcctggccaacatggtgaaaccctgtctctactaaaaatacaaaaattagccgggcatggtggctggcgcctgtaattccagctactcaggaggctgaggcagaagaatcacttgaacccaggaggcagaggtcgcagtgagctgatatcgtgtactgtactccagcctgggtgacggagtgagactctgtctcggaaaaagaacctttgttgccattttctggaaatctcataatacactgaaaggcattgtcatgtagcagtgaagagcacaggctggagccagttgtttgtctaggtttgaatcctggctgggccatttcctagctgtgtgaccttgggcaagttatctgacctctctgtggcctgttttcatcaatggtaaaaagggggtaacaataatatctaccatctaggtattacgggaggattatagaaaatgagttaatatatgtaaaactcttagaacattcttggcatgtagtaagcgctatgttttgttaaataaaataaaatgtaaatgcaaatctaagtcaaccatgcgaatggtgcaactttagatgtgacacttcagcatattgcctaagggcgtgtggggttccctgcaggagggtcatttctgcatacctctgggcccccattgcagtccctcatacccctaactgggcatgataccttctggggggctgtggccagacctgggacttgtcttgtaggaatccctgcagcagcagcagcaggaacaagaggaagccctcaagcagtgtcgggagcagcacgctgccgagctgaaggtgcctctcgcatgatggtgttcctctctccagacagtgacgggccctcctgggaggacagaggcttcccaagccaatgcctaagctgctttctgctttgcagggcaaggaggaggagctacaggatgtacgggatcagctcgagcaggcccaggaggagcgggactgccacctgaagaccattagcagcctgaagcaggtcagtggtcactgcacagccccagacacacccctgatcctcagcgtacaggaggggcagggagggagcatgcttcaggcagcccttccggcatctaccagccatgcctgctttctcccacaggaggtgaaggacacagtggatgggcagaggatcctggagaagaagggcagtgctgcggtaagacagagcggtgcccaagcacggctccctcctacctgtagcctccctcctatgggcccactgggcctcagtcctcatgttacccctgtcccccacagctcaaggacctcaagcggcagctgcatttggagcggaaacgggcagataagctgcaggagcgactgcaggacatcctcactaacagcaagagccgctcaggtgagggactaggacagggagaggaggctgaggcatgggggaggtagggcctgggcctgcaggctgcaggttagtcctgcctcttcctcagctgtgctttcctgcttctgtcgctctggaactccatcttttaccttttctctgtctctcctctgattctttctctgcattctctctttatttctatctttctctcgtttttgccctgtctcttctctgtttctgtctctgcctctgtctcagtttgttctctctctttcctctatgtttgcctttatctccttgctttctttctctagttttctccttttctctctcttttttttttttgagacagagtttcgctcttgttgcccaggctggagtgcaatggtgtgatctcggctcaccgcaacctctgcctcctggattcaagcaattctcctgcctcagcctcctgagtagctgggattacaggcatgcaccaccacgcccagctaattttgtatttttagtagagacggggtttctccatgttggtcaggctggtcccgaactcccgacctcaggtgatccgcccgcctcagcctcccaaagtgttgggattataggcatgagccactgggcccggcccccgccctttcttttctctgtccctttatctcttcccgccactctgtgtcctcttcgtctcttctgtttatatctctgtctgtctcctcactgtatgtactacattacacactcccacacctcacttggcatttctaaatctattgtatacaatctctcattctataaatctccctgctcaagtacagggtccctgatataaaactccctgagtctctgccctctagaagcccccagttgagctacggagacagacttatacatagtcagcaacgctgtggtgttttcattatacagctaatccaatctgttatttctgccacttcaagcagaagacacacacacacacacacacacacacacacacacacaactttagttgcttcagccttttttaagacggggatggcctataaatacatttaagtaagtaaaatgcagtgatggctctggtgcatctcttagattacagactcagagaaaacttggtcccttattcccccactcgggatacctacggatccccactcagtcaccccacccttgccagagatcctcgagggctttaagtgatgtggcaaaacagatgtgtatctctcaccaaatcaatttctctctgaggcactcggtctcctgaagtaacctttctttaaaaaggagttttgtttctgttttatcacagatgaatgtaagaatcttgggaaaggtgtaatcccagcactttgggaggccaaggtgggtggatcacctgaggtcaggggttcaagaccagcctggccaacacggtgaaaccccgtctcaactaaaaatacaaaaaaattagctgggtgtggtggcgggcgcctgtaatcccagctacttcgggaggctgagtcaggagaattgcctgaacccaggaggcaggggttgcagtgagccgagattgcgccattgtactccagcctgggcgacaagactgaaactctgtctaaaaaataataataataataatcttgggaaacgttacaatcgtataccatacattcaatacattcaccttgtccattagattaaactgagatttaggtgcgtgggtacgagagcctgcttgcatcttttttttttttttttttttttttttttttttgagacggagtctcgctctgtcgcccaggctggagtgcagtggcgcgatctcggctcactgcaacctccgcctcccgggttcacaccattctcctgcctcagcctcccaagtagctgggactacaggcacccgccaccacgcccacctaattttttgtatttttagtagagacggggtttcaccgttttagccaggatggtctcgatctcctgacctcgtgatctgcccgcctcggcctcccaaagtgctgggattacaggcgtgagccaccgcgcccggcatctttttttctctctgtctctgctctggctcacttctttcaccagggtctcagtttctatcatctgctctggctttccatctctggcattttctttctgcaagtggatgtgccctgtgccctctctagctgtcttcctttctctgaaccctgtgtccaagtgtgtctgccacttgagacccatgtgtacccatgtcgttctctttctccaacctcttccattttctccctctcattttgtatgtgtttctccagaaaggcagctctttcttttctttctgttttttgtttttttttttttgagacaagagtctcactctgtcacccaggctggagtgcaatggtgcgatttcggctcactgtaacctccgcctgcttgggttcaagcgattctcctgcctcagcctcctgaatcgctggaattacaggcacacacaaccacacctggctaatttttgtatttttagtagagacggggtttcttcatgttggccaggctgttctcgaactcctgacgtcaagtgatcagcccacctcagcctcccaaagtgctgggattacaggtgtgagccagtgcgcccagcctcagctcttttttctgtctctgtctctccctgtcctcctgtctgcttctgcctttccccatgcccaggtgtctctctttccatctctgttaaatctatttctgcctcttcctgctggttgctgccctgggactcaggggtactggggctcaagtttctcttccctccaccacccaggccttgaggagctggttctctcagagatgaactcaccaagccggacccagacaggggacagcagtagcatctcctccttcagctaccgggagatcttgcgggaaaaggagagctcggctgttccagccagggtaaggggaaaggaagaacctacagctccagcttctctcaacccaaaaatctgagaacccctccccttttctcctcacctaaacccatctcctactttgggcgcagcacacatattttcttgtcaacttttccccaagcccaccaacttggattcagattgcgacatgcaggacaggccagtcattctctctctctgactttctgtttaatcatctgtgggctaattcccccttctctggtgccataaattatgtggctcatagtaggtgcaccatccaaggagaaggtccctttttccaacttgtaatgatcactaattattattgccggctgtcatgtcagcctccttaccagccactttcctttggaaataacttttttattgttccacaaatagtatgtgctcattgtagtacattttttaaaaaccacaaatgagcaaagatttttttaaaaccttaaatgtctggccgggtgtggtggctcatccctataatcctacactttgggaggccaaggtgggcggatcacttgagctcaggagtttaagaccagcctgggaaatgtggtaaaactccgactctatttaaaaaaaaaacaaaaacaaaaaaaccttaaatgtcaaaaaaaaataatattttcaccatccagacgtcaccattataaattcttagttcagggctgggcgcggtggctcatgcctgtaaccctagcactttgggaggctgaggcgggcagatcacttgaggttaggagtttgagaactggcctggccaacatagcaaaacctcatctctactaaaatacaaaaattagccgggcgtggtggtgcgtgcctgtagtcccagctactcgaaaggttgaggcaagagaatcgcttgaacctgggaggtggaggttgcaatgagccgagatcacaccactgcactccagcctgggcaacagtgaaactccatctcaaaaaataaataaataaaataaattcttagttcatacccttccagaattctctctctttttaaaacctagatgagattaacctgttttttattcaactgttgtctctaccttcccaatttgatcaattttcatgtcattggctgggtgcggtggctcctgcctataatcccagtactttgggaggccgaggcgggcagatcacttgaggtcaggagttcaagaccagcctggccaacatggtgaaaccccatctctactaaaaatacaaaaattagctgggcgtagtggcgcgtgcctgtaattccatctactcgggaggctgaggcaggagaatcgcttgatcctgggagttggaggttgcagtgagccaagatcttgccattgcactccagcctgggcaacaagagtgaaattctgtctcaaaaaaaaaaaaaaaattcatgtcgtctgatactttgaccttaaccagatttctctagttggccccagaatgtcctttcttgctggttttatgaaaactagcattcagattcagagcacatgttacatctggttgttttatggcccttaaatctctttagtgcggtcccttttttcctgagaccaatttgttgaagaggccagcccagtcaccccacaggaagtatgctaccttttgggtttttctgctggcttcctggtggtatgatttaacatgtccctctcttccagttttcctgtcagctgaaagttagatctcatttgctttgggatcttccttcaatcctctccacaaggctctgatgtggttactctctacccccatttaggcagaggagaaaacagagtctgagggtaccaagatgggccaacagtcccagcttcagggcccatgttctctcacccacctctggcctggttctcctccccagtccctgacacctgtctggggtcggtggtgctgagcccggggctggcctctccccttctctttcctgcagtccttatccagcagccctcaagcccagccccctcggccagcagagctgtcagatgaggaagtggctgagctctttcagcggctggcagagacacagcaggagaaatggatgctggaggagaaggtgctgcctgcctgcctgcctgcccatccccacttgaagtgcccttgtgggtgtggggtctgcccgggcccgcctcatgtgtgaacatgtacagtagaggggtctcaggtgggctgggccatcttgcaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggcaagtgtggcctgccagcctacccatctgttcacccagccacctgcctacccagccacatagcccctgggtcatctgccagtccccttgcccacccacccagcctgtcctcccagctatcctcctacccactcatcaactactccatcatgctctcatcttccaccctctcatcaacttattatccattcattccttccatgtacccgctcatccatttatctacacattcacccaaccatttgcccatctgtccatctacccaatctactacttacttatctcattgtctaccccatgtcctgccacccatttcttgacatatcattctcttatctactcatcaattgccccttgtgttacctttcacccacccagttacctgcctgcccacctgttgatctccatctgtcctctggacaattcattcgtccaccaatttgtctaccatagatcccccatgcccatgggtccacacacacatctttctgcccaaactgccacccaaggactttccccatctctgagagttagaaaggggtcagacccagctcctgcctttgagaagcaagctcacacttagaagagcaggtggccagagtggtggtgtatcctgcagcagcaccatgccacaggaggcatcccactcccattatctgtagctccccacccatcctcatgacttttctgagccctgcccactgttgggggtgctgtgagcttctccaagtaccttctcatcccaggccagacacagctgagcattgattaatgaaagggtgtgagggaaatcacagatgataccctacgtttggcaagggagcagcct

SEQ ID NO: 1141 - DNA, 27912 bp, mus musculus; identical to SEQ ID NO: 1140

SEQ ID NO: 1142 - DNA, 15869 bp, mus musculus
tcaatcagtcaatcaacaaaataagaatctggccaggcacggtggctcatgcctgtaatcccagcactttgggaggctgaggcgggtggatcacctaaggtcaggagttcgagaccagcctggccaacgtggcaaaacccgtctctactaaaaatacaaaaattagccaggtgtggtggcgggtgcctgtaatcccagctactcgggaggctgaggcaggagaatccattgaacccaggaggtggaggttgcagtgagtggagatcacaccactgcgctccagcctaggtgacagaacgagactccgtttcaataaataaataaataaatataaaaaataaaataaaataagaatcttatgagtcccagagagagagagagagagagacaaagctcttcctcacagtaaaatcccaggtatatgtgtaaaagaaaaatcattatttggccaccatcagagtagttattgcttcaggcaagaatcaccaatgaatgctaaagtagtgagtaaaagtttgatttaaaaaaaattgcagagttacagtctcaaagtatctcccgaaaagctacttattaattacaaaaggggatcatgcctgtaatcccagcactttgggaggccaatgcaggaggattgcttaagcccaggaatccgagaccagcctgggcaacatagtgagactgtttctacaaaaaatttaaaaattagccgggcatggtgactcacacctgtagtccttgaagattacatgagcccaggagttcaaagatgcagtgaaccatgattgtgtcaatgccctcaagcttgcgtaatagggcaagaccctgtctccaaaaaaaaagaaaaaaaattacaaagggaaaaatagtaaatttatactggtgaaaactagaagaccactttaagcaaaagatcaatgctaatactaacaatttcgagactaactgaaccctcctgcctcctgataacgctgagaacacagcgtcacttctgtggaattcctgccaaaaatgcagaattcaaatctaatcatgaggagacatcagataaacccaaattgaaggacattcttccaaagaactggtctgtgctctcccaaaacatcaagatcatgaaagttaagtgaagatggagacattgttccacattggaggagactaaaaaaacctgataacagaatgtatcttgtgaccctatgattcccttttcctatacaaggacactattgacatgcccaccagggtggctagaaccaaaaagtcagataacaagtatttgtgaggatgtggagcaatggaaacctcatactatgctggtagcaatgtaaaaaaagaaaaaaaagtccttgctcttaggatattcatactgaagtatttagttaaaagggtgtcatatccgcaaccactaacaaataattcagaaaaatcactgtatatcattcagaaaaattatatatatgtaaattacatatgtatatacatggggagaaagaaacggacagagacagagagagagcaaatatgttatcattataaggcttggcatttttgtcagtcccataagtgaaaaatagtatatcattgtttttaatttgtatctctttaattatggagagctcatctaaaacaccccagaaaccacaacctagaatgaccacagacatttattgagtgtccaccctctactaagctccagtgataaaaatatgaagcacaacatctggtagatgtaaaatggtattatatctcactgttgttttaattttacatttccctgagcagtaaagagattgggttatcttttcatatattatacatattgaccattttaggtttcttctgctgtgaattacctatttgtacccaatgtctattgccaagtgtattgtttgtcctcttcggatttgtagatgttcgttatatatcctaaaacctagatcctacttctttgtgacacaggtcaaaagcctagatggaaacaatcaagtccgcaaagcccaggagcacatgtggtaagaatcttccagttttaaatgccaagtcttgcaattgagggaagtatttctggtaggtgctgtgggtcattgttgactcaacttgagtgggtttgacaactgagaaaaaaattaaaatgaaatttaattcataaaatgtatgtcctgtattctgctgttaaggaaaagaattgatatttgtgcatctggtctaagctattattccttatatatacatattcttaccgtattaaatgttttttgtttgtaatacatgaatactaatttatgagctagaactccatttaacttcatgttaaaatagagagaaaatatacatttctcttcaattaccattggtgtttcccagcaaaaacctgccaagcccactcttttgtttaacagaaaaggacaatggagacgggtgagtgaacatgacttgcccagctccatacaggccattgttaatctgattaaaatctgtttcagttggctgcccaggtcagggtggcgtccagtttgacctgggcttccttctcccttccacgtcacagctaagcatgtagtgcagtaagcgcccagtaagtgctcttttggaaaaataggcccttcatcagcctaggtacaaaggggaatgcctagaaactgcagcagtagggtaggtagaaggcgggtgctacataaatctttagtgttggtgcagatagaggtgcggatggggccagtgtaagcgctttcttttttattttatttatttatttatttagagaaggagtttcgctcttgtttatttatttatttattttggagaaggagttttgctcttgtcacccaggctggagtgcaatggcgtgatctcggctcactgcaacctccgtctcctgggctcaagtgattctcctgcctcagcctccggagtagctgggattacaggcgcccagctaaattttttgtatttttagtagagacagggtttcgccatattggccagcctggtctcaaactcatgacctcaggtgatccatccgcctcggccttccaaagtgctgggttacaggtgtgagccaccacgcccagtctttatttatttattttgagacggagtttcgctcttgtagcccacaatgacgcgatcttggctcactgcaacctctgcctcctgattctcctgctttaacctcccgagtagctgggattacaagcgtgcgccaccacgcctggctaatttttgtatttttagtagagacggggtttcgccatgttggccaggctggtctcgaactcctgacctcaagctatcctcctacccttggcctcccgaagtgctgggtttataggcgtgagccaccgagcctggcccttaagagctttataaatgccccccttttaagtgctcggtactagcctccctctagttcacagagaacatttactagtcgctggggtcaccttcgaagcaaagagtctgctggggaattaagcatgcaaatcacttctcaacgacgacacgccaagtgctcacagctcgtccccaggggaagcacaggcgcctaatttgtgttcctaggtgacacagtcattacttataaatgttcctggccggtcccaggaggtgggagggttgggagttacttcggttctctcaaaggttggggaaggagagatctcggtttgttttcccatctgtgaaacggggacaccacggtatttagaggacgtgcgcgggtgactatttgggggtgcagcggcttccctcctccctcccccatctttcccttctcacttccaaggcttggaaatttggagattcggaagtttgttcttggatggccagaaatcctccggaggcagacggtctggggctgaaaccgccacaggccggaaaggtgcgggcgtgaacgtcctgcgcgccgacgtccccccgcgccggtctcccctcaatcctcctgctcccctcctccgcgtccccgtccccgcccccctcctgctctcccattggccgagccggcggccgggccgccccgggatttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaata

SEQ ID NO: 1143 - DNA, 15869 bp, mus musculus; identical to SEQ ID NO: 1142

SEQ ID NO: 1144 - DNA, 10646 bp, mus musculus; identical to SEQ ID NO: 182
